United States Patent
Knuehl et al.

(10) Patent No.: US 9,932,403 B2
(45) Date of Patent: Apr. 3, 2018

(54) BIOLOGICAL MATERIALS RELATED TO HER3

(75) Inventors: Christine Knuehl, Darmstadt (DE); Bjoern Hock, Maintal (DE); Robert Hofmeister, Scituate, MA (US); Gerald Beste, Ghent (BE); Hilde Adi Pierrette Revets, Meise (BE); Frank Kamiel Delphina Verdonck, Sint-Gillis-Waas (BE); Sigrid Godelieve Victor Cornelis, Sint-Martens-Latem (BE)

(73) Assignee: Ablynx NV, Zwijnaarde (BE)

( * ) Notice: Subject to any disclaimer, the term of this patent is extended or adjusted under 35 U.S.C. 154(b) by 0 days.

(21) Appl. No.: 13/698,992

(22) PCT Filed: May 20, 2011

(86) PCT No.: PCT/EP2011/058295
§ 371 (c)(1),
(2), (4) Date: Jan. 25, 2013

(87) PCT Pub. No.: WO2011/144749
PCT Pub. Date: Nov. 24, 2011

(65) Prior Publication Data
US 2013/0136748 A1 May 30, 2013

Related U.S. Application Data

(60) Provisional application No. 61/346,548, filed on May 20, 2010.

(51) Int. Cl.
| | |
|---|---|
| C07K 16/28 | (2006.01) |
| C07K 16/18 | (2006.01) |
| C07K 16/32 | (2006.01) |
| A61K 39/00 | (2006.01) |

(52) U.S. Cl.
CPC ..........  *C07K 16/2863* (2013.01); *C07K 16/18* (2013.01); *C07K 16/32* (2013.01); *A61K 2039/505* (2013.01); *C07K 2317/22* (2013.01); *C07K 2317/31* (2013.01); *C07K 2317/33* (2013.01); *C07K 2317/567* (2013.01); *C07K 2317/569* (2013.01); *C07K 2317/73* (2013.01); *C07K 2317/76* (2013.01); *C07K 2317/77* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | | |
|---|---|---|---|
| 2006/0270003 A1 | 11/2006 | Arnott et al. | |
| 2007/0065440 A1* | 3/2007 | Tomlinson et al. | 424/145.1 |
| 2008/0124345 A1* | 5/2008 | Rothe et al. | 424/174.1 |
| 2008/0241138 A1 | 10/2008 | Levin et al. | |
| 2008/0241166 A1* | 10/2008 | Tomlinson et al. | 424/172.1 |
| 2009/0148447 A1 | 6/2009 | Ledbetter et al. | |
| 2009/0252681 A1 | 10/2009 | Laeremans et al. | |
| 2010/0266609 A1 | 10/2010 | Adams et al. | |

FOREIGN PATENT DOCUMENTS

| | | |
|---|---|---|
| CL | 1213-2015 A | 7/2015 |
| CN | 101674846 A | 3/2010 |
| JP | 2008-520224 A | 6/2008 |
| JP | 2009-511032 A | 3/2009 |
| JP | 2009-521913 A | 6/2009 |
| JP | 2010-506580 A | 3/2010 |
| WO | WO-2006/013107 A1 | 2/2006 |
| WO | WO-2006/054059 A1 | 5/2006 |
| WO | WO-2006/088833 A2 | 8/2006 |
| WO | WO-2007/149032 A1 | 12/2007 |
| WO | WO-2008/001063 A1 | 1/2008 |
| WO | WO-2008/047134 A2 | 4/2008 |

(Continued)

OTHER PUBLICATIONS

Goldsby et al. (Immunology, 5th edition, 2003, pp. 82-84).*
Rudikoff et al. (Proc. Natl. Acad. Sci. USA, 79(6):1979-1983, 1982).*
McCarthy and Hill (J. Immunol. Methods, 251(1-2):137-149, 2001).*
Stancovski et al. (PNAS, 88:8691-8695, 1991).*
Jiang et al. (J. Biol. Chem., 280:4656-4662, 2005).*
Achour et al., "Tetrameric and Homodimeric Camelid IgGs Originate from the Same IgH Locus," The Journal of Immunology, vol. 181, No. 3, pp. 2001-2009.
Scamurra et al., "Mucosal Plasma Cell Repertoire During HIV-1 Infection," The Journal of Immunology, vol. 169, 2002, pp. 4008-4016.
Watkins et al., "Single-chain antibody fragments derived from a human synthetic phage-display library bind thrombospondin and inhibit sickle cell adhesion," Blood, vol. 102, No. 2, Jul. 15, 2003, pp. 718-724.
Woolven et al., "The structure of the llama heavy chain constant genes reveals a mechanism for heavy-chain antibody formation," Immunogenetics, vol. 50, 1999, pp. 98-101.
International Search Report for PCT/EP2011/058295—mailed Aug. 11, 2011.

(Continued)

*Primary Examiner* — Nelson B Moseley, II
(74) *Attorney, Agent, or Firm* — Gilberto M. Villacorta; Peng Sun; Foley & Lardner LLP

(57) ABSTRACT

The present disclosure relates to amino acid sequences that are directed against (as defined herein) HER3, as well as to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively). The disclosure also relates to nucleic acids encoding such amino acid sequences and polypeptides (also referred to herein as "nucleic acids of the invention" or "nucleotide sequences of the invention"); to methods for 10 preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

8 Claims, 76 Drawing Sheets

(56) References Cited

FOREIGN PATENT DOCUMENTS

| WO | WO-2008/054603 A2 | 5/2008 |
|---|---|---|
| WO | WO-2008/067223 A2 | 6/2008 |
| WO | WO-2008/100624 A2 | 8/2008 |
| WO | WO-2009/136286 A2 | 11/2009 |
| WO | WO-2010/025400 A2 | 3/2010 |
| WO | WO-2010/034443 A1 | 4/2010 |
| WO | WO-2010/102251 A2 | 9/2010 |
| WO | WO-2010/128407 A2 | 11/2010 |
| WO | WO-2011/053763 A2 | 5/2011 |
| WO | WO-2011/088120 A9 | 7/2011 |
| WO | WO-2012/045848 A1 | 4/2012 |
| WO | WO-2012/059598 A1 | 5/2012 |
| WO | WO-2012/095662 A1 | 7/2012 |
| WO | WO-2013/063110 A1 | 5/2013 |
| WO | WO-2013/150043 A | 10/2013 |
| WO | WO-2013/158577 A1 | 10/2013 |
| WO | WO-2014/122613 A1 | 8/2014 |

OTHER PUBLICATIONS

Sciioeberi, Birgit et al: "An ErbB3 antibody, MM-121, is active in cancers with ligand-dependent activation", Cancer Research/American Association for Cancer Research, AACR, Philadelphia, PA, vol. 70, No. 6, Mar. 15, 2010, pp. 2485-2494, XP002581703.
Tijink Bernard M et al,: "Improved tumor targeting of anti-epidermal growth factor receptor Nanobodies through albumin binding: taking advantage of modular Nanobody technology", Molecular Cancer Therapeutics, American Association of Cancer Research, US, vol. 7, No. 8, Aug. 1, 2008, pp. 2288-2297, XP009124410.
Treder M et al: "309 POSTER Fully human anti-HER3 mAb U3-1287 (AMG 888) demonstrates unique in vitro and in vivo activities versus other HER family inhibitors in NSCLC models", European Joural of Cancer, Supplement, Pergamon, Oxford, GB, vol. 6, No. 12, Oct. 1, 2008, p. 99, XP025534373.
Josefin-Beatz Holz, "Developing Nanobodies; From Bench to Bedside," Jun. 24, 2008, pp. 1-37, Retrieved from the Internet: http://www.pda.org/Presentation/2008PDAEBEDublin/holzjosefin.asp.
Office Action issued in European Patent Application No. 11720539.3 mailed Feb. 26, 2016.
English Translation of Chinese Office Action corresponding to U.S. Pat. No. 201180021948, dated Jun. 17, 2015, 7 pages.
Notification of Reasons for Refusal issued in co-pending Japanese Application No. 2013-510642 dated Jun. 15, 2015, with partial English translation.
Chinese Office Action with English translation issued in co-pending Chinese Patent Application No. 201280033175.1 dated Sep. 16, 2015.
EBI Dbfetch Database Entry, DI572183, Feb. 21, 2008, available at http://www.ebi.ac.uk/Tools/dbfetch/dbfetch?db=KPOP;id=DI572183;format=default.
EBI Dbfetch Database Entry, DI579107, Feb. 21, 2008, available at http://www.ebi.ac.uk/Tools/dbfetch/dbfetch?db=KPOP;id=DI579107;format=default.
Ely et al "01CStructural basis of receptor sharing by interleukin 17 cytokines01D" Nature Immunology, vol. 10, Dec. 2009, pp. 1245-1251.
First Examination Report issued in co-pending New Zealand Application No. 616761 dated Sep. 5, 2014.
Further Examination Report issued in co-pending New Zealand Application No. 616761 dated Aug. 7, 2015.
Further Examination Report issued in corresponding New Zealand Application No. 616761 dated Nov. 18, 2015.
Gaffen "01CStructure and signalling in the IL-17 receptor family01D". Nature Review Immunology, vol. 9, Aug. 2009, pp. 556-567.
Ghahroudi, M. Arbabi et al., "Selection and Identification of Single Domain Antibody Fragments from Camel Heavy-Chain Antibodies," FEBS Letters, vol. 414, No. 3, Sep. 15, 1997, pp. 521-526, XP004261105.
Holt, Lucy J. et al., "Domain Antibodies: Proteins for Therapy," Trends in Biotechnology, vol. 21, No. 11, Nov. 1, 2003, pp. 484-490, XP004467495.
International Search Report and Written Opinion received in Application No. PCT/EP2012/058313, dated Oct. 29, 2012.
Notification of Reasons for Refusal dated May 12, 2016 in related Japanese Appl. 2014-508842 with English-language translation.
Notification regarding Completion of Substantive Examination dated Jun. 2, 2014 in related Eurasian patent application No. 201391632 (2 pgs.).
NZ Tribunal Pantex Pty Ltd (1996)NZIPOPAT 6 (Jun. 13, 1996).
NZ Tribunal Song, Jiasheng (2015)NZIPOPAT 20 (May 27, 2015).
Office Action and Search Report issued in co-pending Chinese Application No. 201280033175.1 dated Mar. 9, 2015, with partial English translation.
Office Action dated Sep. 21, 2016 in related Ukrainian Appl. 2013-14154 with English-language translation.
Office Action issued in co-pending Chinese Application No. 201280033175.1 dated Jan. 8, 2016, with English translation.
Office Action issued in corresponding Eurasian application No. 201391632 dated Oct. 30, 2015 with English translation.
Vincke, Cecile et al., "General Stategy to Humanize a Camelid Single-domain Antibody and Identification of a Universal Humanized Nanobody Scaffold," The Journal of Biological Chemistry, vol. 284, No. 5, Jan. 30, 2009, pp. 3273-3284, XP009124408.
Examination Report dated May 18, 2016 in related Chilean Appl. 3090-2013.
Di Cosimo, S. et al. "Management of breast cancer with targeted agents: importance of heterogenicity". Nat. Rev. Clin. Oncol., vol. 7, 2010, pp. 139-147.

* cited by examiner

Figure 1:

| Name | SEQ ID NO: | Nucleotide sequence |
|---|---|---|
| 18F05 | 27 | GAGGTGCAATTGGTGGAGTCTGGGGGAGGCTTGGTGCAGCCTGGGGGGTCTCTGAGACTCTCCTGTGTAGCCTCTGGATTCACGTTCAGTTCCTACTGGATGTATTGGGTCCGTCAGGCTCCAGGGAAGGGGGTCGAGTGGGTCTCAGCAATTAGTCCTGGTGGTGTTGAACGATATACAGACTCCGTGAAGGGCCGATTCACCATCTCCAGAGACAACGCCAAAAACACACTGTATCTCCAAATGAACAGTCTGAAATCTGAGGACACGGCCATGTATTACTGTGCACGACTAACATCTTTTGCCACACCCGAGAGCCAGGGGACCCAGGTCACCGTCTCCTCAGCGGCCGCAGAACAAAAACTCATCTCAGAAGAGGATCTGAATGGGGCCGCACATCATCATCATCATCAT |
| 17B05 | 28 | GAGGTGCAATTGGTGGAGTCTGGGGGAGGCTTGGTGCAACCTGGGGGGTCTCTGAGACTCTCCTGCGCAGCCTCTGGAAGCATCGGCGGTCTCAATGCCATGGCCTGGTACCGCCAGGCTCCAGGAAAAGAGCGCGAGTTGGTCGCAGGTATTTTGGCGTTGGTAGCACGAGGTACGCGGACTCCGTGAAGGGCCGATTCACCATCTCTAGAGACATCGCCAAGAACACGGTGTTTCTGCAAATGAACAGCCTGAATTCTGAGGACACGGCCGTTTATTACTGTCGGATGTCAAGTGTTACTCGTGGTAGTTCTGACTACTGGGGTCAGGGGACCCAGGTCACCGTCTCCTCAGCGGCCGCAGAACAAAAACTCATCTCAGAAGAGGATCTGAATGGGGCCGCACATCATCATCATCAT |
| 18B05 | 29 | GAGGTGCAATTGGTGGAGTCTGGGGGAGGATTGGTGCAGGCTGGGGGCTCTCTGAGACTCTCCTGTGCAGCCTCTGGACTGACGTTCGGTAGCGCGCCTATGGGCTGGTACCGCCAGGCTCCAGGGAAGGAGCGCGAGTTGGTCGCTTATATTAGTGGTGATGAGAGAATATGGTATGGAGACTCTGTGAAGGGGCGATTCACCATCTCCAGAGACACTACCAAGAACACGCTGTATCTGCAAATGAACAGCCTGAAACCTGAGGACACGGCCGTTTATTATTGTGTATCAGATGTTAAAGTCAGGCACTGGGGCCAGGGGACCCAGGTCACCGTCTCCTCAGCGGCCGCAGAACAAAAACTCATCTCAGAAGAGGATCTGAATGGGGCCGCACATCATCATCATCATCAT |
| 04C07 | 30 | GAGGTGCAATTGGTGGAGTCTGGGGGAGGCTTGGTGCAGGCTGGGGGGTCTCTGAGACTCTCCTGTGCAGCCTCTGGATTCACCTTCAGTAGCTATCCCATGAGCTGGGTCCGCCAGGCTCCAGGAAAGGGGCCCGCGTGGGTCTCAACTGTTAGTCCTGGTGGTATAACCACAAGCTATGCAGACTCCGTGAAGGGCCGATTCACCATCTCCAGAGACAACGCCAAGAACACGCTGTATTTGCAAATGAACAGCCTGAAACCTGAGGACACGGCCGTGTATTACTGCTTAAGAGATCTGAATAATAGGGGCCAGGGGACCCAGGTCACCGTCTCCTCAGCGGCCGCAGAACAAAAACTCATCTCAGAAGAGGATCTGAATGGGGCCGCACATCATCATCATCATCAT |
| 18G11 | 31 | GAGGTGCAATTGGTGGAGTCTGGGGGAGGCTTGGTGCAGCCTGGG |

Figure 1 (Continued):

| | | |
|---|---|---|
| | | GGGTCTCTGAGACTCTCCTGTGCAGCCTCTGGAACGCTCTTCAAAA TCAACGCCATGGGCTGGTACCGCCAGGCTCCAGGGAAGCGGCGCG AGTTGGTCGCACTTATTACTAGTAGCGATACAACGGATTATGCAGA GTCCGTGGAGGGCCGATTCACCATCTCCAGAGACAACACGTGGAA CGCGGTGTATCTGCAAATGAACAGTCTGAAACCTGAGGATACGGC CGTCTATTACTGTCACTCAGATCATTACTCGATGGGTGTGCCTGAA AAGCGAGTCATAATGTACGGCCAGGGGACCCAGGTCACCGTCTCC TCAGCGGCCGCAGAACAAAAACTCATCTCAGAAGAGGATCTGAAT GGGGCCGCACATCATCATCATCATCAT |
| 18 E08 | 32 | GAGGTGCAATTGGTGGAGTCTGGGGGAGGCTTGGTGCAGCCTGGG GGGTCTCTGAGACTCTCCTGTGCAGCCTCTGGAACGCTCTTCAAAA TCAACGCCATGGGCTGGTACCGCCAGGCTCCAGGGAAGCAGCGCG AGTTGGTCGCACTTATTACTAGTAGCGATACAACGGATTATGCAGA GTCCGTGGAGGGCCGATTCACCATCTCCAGAGACAACACGTGGAA CGCGGTGTATCTGCAAATGAACAGTCTGAAACCTGAGGATACGGC CGTCTATTACTGTCACTCAGATCATTACTCGATGGGTGTGCCTGAA AAGCGAGTCATAATGTACGGCCAGGGGACCCAGGTCACCGTCTCC TCAGCGGCCGCAGAACAAAAACTCATCTCAGAAGAGGATCTGAAT GGGGCCGCACATCATCATCATCATCAT |
| 34C07 | 33 | GAGGTGCAATTGGTGGAGTCTGGGGGAGGCTTGGTGCAGCCTGGG GGGTCTCTGGGACTCTCCTGTGTAGCCTCTGGAAGCATCTTCAGAA TCAATGCCATGGCCTGGTACCGCCAGGCTCCAGGGAAGCAGCGCG AGTTGGTCGCGGAAATTACTGCTGGTGGTAGCACAAACTATGCAG ACTCCGTGAAGGGCCGATTCACCATCTCCGTAGACAACGCCTGGA ACACGCTGTATCTGCAAATGAACAGCCTGAAAGTTGAGGACACGG CCGTCTATTACTGTAATCTAGATCATTATACGACATGGGATAGACG GAGTGCCTACTGGGGCCAGGGGACCCAGGTCACCGTCTCCTCAGC GGCCGCAGAACAAAAACTCATCTCAGAAGAGGATCTGAATGGGGC CGCACATCATCATCATCATCAT |
| 05A09 | 34 | GAGGTGCAATTGGTGGAGTCTGGGGGAGGCTTGGTGCAGGCTGGG GGGTCTCTGAGACTCTCCTGTGCAGCCTCTGGATTCACTTTCGATG ATTATGCCATAGGCTGGTTCCGCCAGGCCCCAGGGAAGGAGCGTG AGGGGGTCTCATGTATTAGTAGTAGTGATGGTAGCACAGTCTATGC AGACTCCGTGAAGGGCCGATTCACCATCTCCAGTGACAACGCCAA GAACACGGTGTATCTGCAAATGAACAGCCTGAAACCTGAGGACAC GGCCGTTTATTACTGTGCAGCAGAACGACGGAGGGGCTATAGCGA TTTATGTAGGTTTTACTACGGCATGGACTACTGGGGCAAAGGGACC CAGGTCACCGTCTCCTCAGCGGCCGCAGAACAAAAACTCATCTCA GAAGAGGATCTGAATGGGGCCGCACATCATCATCATCATCAT |
| 17C08 | 35 | GAGGTGCAATTGGTGGAGTCTGGGGGCGGATTGATGCAGGCTGGG GACTCTCTGAGACTCTCCTGTGCAGCCTCTGGACGGGCCTTCAGTA GCTATGCCTTAGGCTGGTTCCGCCGGGCTCCAGGGAAGGAGCGTG AGTGTGTAGCAGCGACTGACCGGCTTGGTGATAACACATACTTTCC AGATTCCGTGAAGGGCCGATTCACCATCTCCAGAGACAACGCCAA GAACACACTGTATCTACAAATGAACAACCTTAAGCCTGAGGACAC GGCCGTTTATTACTGCGCAGCAGGGGCCGTTCGGTACGGTGTTAGT |

Figure 1 (Continued):

| | | |
|---|---|---|
| | | ACGAGTCCGATGAACTATAACTACTGGGGCCAGGGGACCCAGGTC ACCGTCTCCTCAGCGGCCGCAGAACAAAAACTCATCTCAGAAGAG GATCTGAATGGGGCCGCACATCATCATCATCAT |
| 21B02 | 36 | GAGGTGCAATTGGTGGAGTCTGGGGGAGGCTTGGTGCAGCCTGGG GGGTCTCTGAGACTCTCCTGTGCAGCCTCTGGATTCACTTTTGATTA TTATACCATAGGCTGGTTCCGCCAGGCCCCAGGGAAGGAGCGCGA GGGGGTCTCATGTATTAGTAGTAGGGATGGTGACTCATACTATGCA GACTCCGTGAAGGGCCGATTCACCATCTCCAGAGACAACGCCAAG AACACGGCGTATCTGCAAATGAACAGCCTGAAACCTGAGGACACG GCCGTTTATTACTGTGCAGCATCAGCTTCTGACTACGGGTTGGGGT TGGAGTTGTTCCACGATGAGTATAACTACTGGGGCCAGGGGACCC AGGTCACCGTCTCCTCAGCGGCCGCAGAACAAAAACTCATCTCAG AAGAGGATCTGAATGGGGCCGCACATCATCATCATCAT |
| 21F06 | 37 | GAGGTGCAATTGGTGGAGTCTGGGGGAGGATTGGTGCAGGCTGGG GGCTCTCTGAGACTCTCCTGTGCAGCCTCTGGACGCACGTACTATC TCAATGCCATGGGCTGGTTCCGCCAGGGTCCAGGGAAGGACCGTG AGTTTGTAGCAGCTATAGACTGGAGTGATGGTAACAAAGACTATG CAGACTCCGTGAAGGGCCGATTCACCATCTCCAGAGACAACGCCA AGAACACGGTGTATCTGCAAATGAACAGCCTGAAACCTGAGGACA CGGCCGTTTATTACTGTGCAGCCGACACACCACCCTGGGGGCCTAT GATCTACATCGAATCGTATGACTCCTGGGGCCAGGGGACCCAGGT CACCGTCTCCTCAGCGGCCGCAGAACAAAAACTCATCTCAGAAGA GGATCTGAATGGGGCCGCACATCATCATCATCAT |
| 23F05 | 38 | GAGGTGCAATTGGTGGAGTCTGGGGGAGGCTTGGTGCAGGCTGGG GGGTCTCTGAGACTCTCCTGTGCAGCCTCTGGATTCACTTTCGATG GTTATGCCATAGGCTGGTTCCGCCAGGCCCCAGGGAAGGAGCGTG AGGGGGTCTCATGTATTAGTGGTGGTGATGGCCGCTCATACTATGC AGACTCCGTGAAGGGCCGATTCACCGTCTCCAGTGACAACGCCAA GAACACGCTGTATCTGGAAATGAACAGCCTGAAACCTGAGGACAC GGCCGTTTATTACTGTGCAGTCATATGGGGCCCTTACTGTAGCGAC TCGTATGAGTATTTGTATGAGTATGACTACTGGGGCCAGGGGACCC AGGTCACCGTCTCCTCAGCGGCCGCAGAACAAAAACTCATCTCAG AAGAGGATCTGAATGGGGCCGCACATCATCATCATCAT |
| 34A04 | 39 | GAGGTGCAATTGGTGGAGTCTGGGGGAGGCTTGGTGCAGGCTGGG GGGTCTCTGAGACTCTCCTGTGCAGCCTCTGGATTCACTTTCGATG ATTATACCATAGGCTGGTTCCGCCAGGCCCCAGGGAAGGAGCGTG AGGAGATCTCATGTATTAGTAACAATGATGGTAGCACATACTATAC AAACTCCGTGAAGGGCCGATTCACCATCTCCAGTGACAACGCCAA GAACACGGTGTATCTGCAAATGAACAGCCTGAAACCTGAGGACAC GGCCGTTTATTACTGTGCAGCGTCCCCCATGGCTGCTGGTACGAC CTAATACCCCTTCAGGCTGACTTTGGTTCCTGGGGCCAGGGGACCC AGGTCACCGTCTCCTCAGCGGCCGCAGAACAAAAACTCATCTCAG AAGAGGATCTGAATGGGGCCGCACATCATCATCATCAT |
| 17 E08 | 40 | GAGGTGCAATTGGTGGAGTCTGGGGGAGGGTTGGTGCAGCCTGGG GGGTCTCTGAGACTCTCCTGTTCAGCCTCTGGAAGCATCTTCGGTC TCAATGCCATGGGCTGGTACCGCCAGACTCCAGGGAAGGAGCGCG |

Figure 1 (Continued):

| | | |
|---|---|---|
| | | AGTTGGTCGCAGGTATTACTAGTATTACTAGAGTTGGTAGTACAAG
GTATGCGGACTCCGCGAAGGGCCGATTCACCATCTCCGGAGACTA
CGCCAAGAACACGGTGTATCTGCAAATGAACAGCCTGAAACCTGA
GGACACGGGCGTTTATTACTGTCGGATGTCAATCGTTAAAAGTGGT
GGTGCTGACTACTGGGGTCAGGGGACCCAGGTCACCGTCTCCTCAG
CGGCCGCAGAACAAAAACTCATCTCAGAAGAGGATCTGAATGGGG
CCGCACATCATCATCATCATCAT |
| 4F10 | 41 | GAGGTGCAATTGGTGGAGTCTGGGGGAGGCTTGGTGCAGCCTGGG
GGGTCTCTGAAGCTCTCCTGTGTAGCCTCTGGAAGCATGTTCAGAT
TCTATCACATGGCCTGGTACCGCCAGGCTCCAGGGGAGCAGCGCG
AGCTGGTCGCACGTATCTATACTGGTGGTGACACAATCTATGGAGA
CTCCGTGCTGGGCCGATTCACCATCTCCAGAGACAATTCCAAGAAC
ACGGTGTATCTACAAATGAACACCCTGAAACCTGAGGACACGGGC
GTCTATTACTGTAATGCCTTCAGGGAGTATCACATCTGGGGCCAGG
GGACCCAGGTCACCGTCTCCTCAGCGGCCGCAGAACAAAAACTCA
TCTCAGAAGAGGATCTGAATGGGGCCGCACATCATCATCATCATCA
T |
| HER3
MS000
22 | 328 | ATGAGATTTCCTTCAATTTTTACTGCTGTTTTATTCGCAGCATCCTC
CGCATTAGCTGCTCCAGTCAACACTACAACAGAAGATGAAACGGC
ACAAATTCCGGCTGAAGCTGTCATCGGTTACTCAGATTTAGAAGGG
GATTTCGATGTTGCTGTTTTGCCATTTTCCAACAGCACAAATAACG
GGTTATTGTTTATAAATACTACTATTGCCAGCATTGCTGCTAAAGA
AGAAGGGGTATCTCTCGAGAAAGAGAGGTGCAATTGGTGGAGTC
TGGGGGAGGATTGGTGCAGGCTGGGGGCTCTCTGAGACTCTCCTGT
GCAGCCTCTGGACGCACGTACTATCTCAATGCCATGGGCTGGTTCC
GCCAGGGTCCAGGGAAGGACCGTGAGTTTGTAGCAGCTATAGACT
GGAGTGATGGTAACAAAGACTATGCAGACTCCGTGAAGGGCCGAT
TCACCATCTCCAGAGACAACGCCAAGAACACGGTGTATCTGCAAA
TGAACAGCCTGAAACCTGAGGACACGGCCGTTTATTACTGTGCAGC
CGACACACCACCCTGGGGGCCTATGATCTACATCGAATCGTATGAC
TCCTGGGGCCAGGGGACCCTGGTCACGGTCTCCTCCGGAGGCGGT
GGGTCAGGTGGCGGAGGCAGCGGTGGAGGAGGTAGTGGCGGTGG
CGGTAGTGGGGGTGGAGGCAGCGGAGGCGGAGGCAGTGGGGGCG
GTGGATCCGAGGTGCAGTTGGTGGAGTCTGGGGGAGGATTGGTGC
AGGCTGGGGGCTCTCTGAGACTCTCCTGTGCAGCCTCTGGACGCAC
GTACTATCTCAATGCCATGGGCTGGTTCCGCCAGGGTCCAGGGAAG
GACCGTGAGTTTGTAGCAGCTATAGACTGGAGTGATGGTAACAAA
GACTATGCAGACTCCGTGAAGGGCCGATTCACCATCTCCAGAGAC
AACGCCAAGAACACGGTGTATCTGCAAATGAACAGCCTGAAACCT
GAGGACACGGCCGTTTATTACTGTGCAGCCGACACACCACCCTGG
GGGCCTATGATCTACATCGAATCGTATGACTCCTGGGGCCAGGGG
ACCCTGGTCACGGTCTCGAGCGGAGGGGAGGTAGTGGGGGTGGC
TCAGAGGTACAACTAGTGGAGTCTGGGGGTGGCTTGGTGCAACCG
GGTAACAGTCTGCGCCTTAGCTGCGCAGCGTCTGGCTTTACCTTCA
GCTCCTTTGGCATGAGCTGGGTTCGCCAGGCTCCGGGAAAAGGACT
GGAATGGGTTTCGTCTATTAGCGGCAGTGGTAGCGATACGCTCTAC |

Figure 1 (Continued):

| | | |
|---|---|---|
| | | GCGGACTCCGTGAAGGGCCGTTTCACCATCTCCCGCGATAACGCCA AAACTACACTGTATCTGCAAATGAATAGCCTGCGTCCTGAAGACAC GGCCGTTTATTACTGTACTATTGGTGGCTCGTTAAGCCGTTCTTCAC AGGGTACCCTGGTCACCGTCTCCTCA |
| HER3 MS000 23 | 329 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGATTGGTGCAGGCTGGGGCTCTCTGAGACTCTCCTGT GCAGCCTCTGGACGCACGTACTATCTCAATGCCATGGGCTGGTTCC GCCAGGGTCCAGGGAAGGACCGTGAGTTTGTAGCAGCTATAGACT GGAGTGATGGTAACAAAGACTATGCAGACTCCGTGAAGGGCCGAT TCACCATCTCCAGAGACAACGCCAAGAACACGGTGTATCTGCAAA TGAACAGCCTGAAACCTGAGGACACGGCCGTTTATTACTGTGCAGC CGACACACCACCCTGGGGGCCTATGATCTACATCGAATCGTATGAC TCCTGGGGCCAGGGGACCCTGGTCACGGTCTCCTCCGGAGGCGGT GGGTCAGGTGGCGGAGGCAGCGGTGGAGGAGGTAGTGGCGGTGG CGGTAGTGGGGGTGGAGGCAGCGGAGGCGGAGGCAGTGGGGGCG GTGGATCCGAGGTGCAGTTGGTGGAGTCTGGGGGAGGCTTGGTGC AGCCTGGGGGGTCTCTGGGACTCTCCTGTGTAGCCTCTGGAAGCAT CTTCAGAATCAATGCCATGGCCTGGTACCGCCAGGCTCCAGGGAA GCAGCGCGAGTTGGTCGCGGAAATTACTGCTGGTGGTAGCACAAA CTATGCAGACTCCGTGAAGGGCCGATTCACCATCTCCGTAGACAAC GCCTGGAACACGCTGTATCTGCAAATGAACAGCCTGAAAGTTGAG GACACGGCCGTCTATTACTGTAATCTAGATCATTATACGACATGGG ATAGACGGAGTGCCTACTGGGGCCAGGGGACCCTGGTCACGGTCT CGAGCGGAGGGGGAGGTAGTGGGGGTGGCTCAGAGGTACAACTA GTGGAGTCTGGGGGTGGCTTGGTGCAACCGGGTAACAGTCTGCGC CTTAGCTGCGCAGCGTCTGGCTTTACCTTCAGCTCCTTTGGCATGA GCTGGGTTCGCCAGGCTCCGGGAAAAGGACTGGAATGGGTTTCGT CTATTAGCGGCAGTGGTAGCGATACGCTCTACGCGGACTCCGTGAA GGGCCGTTTCACCATCTCCCGCGATAACGCCAAAACTACACTGTAT CTGCAAATGAATAGCCTGCGTCCTGAAGACACGGCCGTTTATTACT GTACTATTGGTGGCTCGTTAAGCCGTTCTTCACAGGGTACCCTGGT CACCGTCTCCTCA |
| HER3 MS000 24 | 330 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGATTGGTGCAGGCTGGGGCTCTCTGAGACTCTCCTGT GCAGCCTCTGGACGCACGTACTATCTCAATGCCATGGGCTGGTTCC GCCAGGGTCCAGGGAAGGACCGTGAGTTTGTAGCAGCTATAGACT |

Figure 1 (Continued):

| | | |
|---|---|---|
| | | GGAGTGATGGTAACAAAGACTATGCAGACTCCGTGAAGGGCCGAT
TCACCATCTCCAGAGACAACGCCAAGAACACGGTGTATCTGCAAA
TGAACAGCCTGAAACCTGAGGACACGGCCGTTTATTACTGTGCAGC
CGACACACCACCCTGGGGGCCTATGATCTACATCGAATCGTATGAC
TCCTGGGGCCAGGGGACCCTGGTCACGGTCTCCTCCGGAGGCGGT
GGGTCAGGTGGCGGAGGCAGCGGTGGAGGAGGTAGTGGCGGTGG
CGGTAGTGGGGGTGGAGGCAGCGGAGGCGGAGGCAGTGGGGGCG
GTGGATCCGAGGTGCAGTTGGTGGAGTCTGGGGGAGGCTTGGTGC
AGGCTGGGGGGTCTCTGAGACTCTCCTGTGCAGCCTCTGGATTCAC
CTTCAGTAGCTATCCCATGAGCTGGGTCCGCCAGGCTCCAGGAAAG
GGGCCCGCGTGGGTCTCAACTGTTAGTCCTGGTGGTATAACCACAA
GCTATGCAGACTCCGTGAAGGGCCGATTCACCATCTCCAGAGACA
ACGCCAAGAACACGCTGTATTTGCAAATGAACAGCCTGAAACCTG
AGGACACGGCCGTGTATTACTGCTTAAGAGATCTGAATAATAGGG
GCCAGGGGACCCTGGTCACGGTCTCGAGCGGAGGGGGAGGTAGTG
GGGGTGGCTCAGAGGTACAACTAGTGGAGTCTGGGGGTGGCTTGG
TGCAACCGGGTAACAGTCTGCGCCTTAGCTGCGCAGCGTCTGGCTT
TACCTTCAGCTCCTTTGGCATGAGCTGGGTTCGCCAGGCTCCGGGA
AAAGGACTGGAATGGGTTTCGTCTATTAGCGGCAGTGGTAGCGAT
ACGCTCTACGCGGACTCCGTGAAGGGCCGTTTCACCATCTCCCGCG
ATAACGCCAAAACTACACTGTATCTGCAAATGAATAGCCTGCGTCC
TGAAGACACGGCCGTTTATTACTGTACTATTGGTGGCTCGTTAAGC
CGTTCTTCACAGGGTACCCTGGTCACCGTCTCCTCA |
| HER3
MS000
26 | 331 | ATGAGATTTCCTTCAATTTTTACTGCTGTTTTATTCGCAGCATCCTC
CGCATTAGCTGCTCCAGTCAACACTACAACAGAAGATGAAACGGC
ACAAATTCCGGCTGAAGCTGTCATCGGTTACTCAGATTTAGAAGGG
GATTTCGATGTTGCTGTTTTGCCATTTTCCAACAGCACAAATAACG
GGTTATTGTTTATAAATACTACTATTGCCAGCATTGCTGCTAAAGA
AGAAGGGGTATCTCTCGAGAAAGAGAGGTGCAATTGGTGGAGTC
TGGGGGAGGCTTGGTGCAGCCTGGGGGGTCTCTGGGACTCTCCTGT
GTAGCCTCTGGAAGCATCTTCAGAATCAATGCCATGGCCTGGTACC
GCCAGGCTCCAGGGAAGCAGCGCGAGTTGGTCGCGGAAATTACTG
CTGGTGGTAGCACAAACTATGCAGACTCCGTGAAGGGCCGATTCA
CCATCTCCGTAGACAACGCCTGGAACACGCTGTATCTGCAAATGAA
CAGCCTGAAAGTTGAGGACACGGCCGTCTATTACTGTAATCTAGAT
CATTATACGACATGGGATAGACGGAGTGCCTACTGGGGCCAGGGG
ACCCTGGTCACGGTCTCCTCCGGAGGCGGTGGGTCAGGTGGCGGA
GGCAGCGGTGGAGGAGGTAGTGGCGGTGGCGGTAGTGGGGGTGG
AGGCAGCGGAGGCGGAGGCAGTGGGGGCGGTGGATCCGAGGTGC
AGTTGGTGGAGTCTGGGGGAGGATTGGTGCAGGCTGGGGGCTCTC
TGAGACTCTCCTGTGCAGCCTCTGGACGCACGTACTATCTCAATGC
CATGGGCTGGTTCCGCCAGGGTCCAGGGAAGGACCGTGAGTTTGT
AGCAGCTATAGACTGGAGTGATGGTAACAAAGACTATGCAGACTC
CGTGAAGGGCCGATTCACCATCTCCAGAGACAACGCCAAGAACAC
GGTGTATCTGCAAATGAACAGCCTGAAACCTGAGGACACGGCCGT
TTATTACTGTGCAGCCGACACACCACCCTGGGGGCCTATGATCTAC |

Figure 1 (Continued):

| | | |
|---|---|---|
| | | ATCGAATCGTATGACTCCTGGGGCCAGGGGACCCTGGTCACGGTCT CGAGCGGAGGGGGAGGTAGTGGGGGTGGCTCAGAGGTACAACTA GTGGAGTCTGGGGGTGGCTTGGTGCAACCGGGTAACAGTCTGCGC CTTAGCTGCGCAGCGTCTGGCTTTACCTTCAGCTCCTTTGGCATGA GCTGGGTTCGCCAGGCTCCGGGAAAAGGACTGGAATGGGTTTCGT CTATTAGCGGCAGTGGTAGCGATACGCTCTACGCGGACTCCGTGAA GGGCCGTTTCACCATCTCCCGCGATAACGCCAAAACTACACTGTAT CTGCAAATGAATAGCCTGCGTCCTGAAGACACGGCCGTTTATTACT GTACTATTGGTGGCTCGTTAAGCCGTTCTTCACAGGGTACCCTGGT CACCGTCTCCTCA |
| HER3 MS000 28 | 332 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGCTTGGTGCAGCCTGGGGGTCTCTGGGACTCTCCTGT GTAGCCTCTGGAAGCATCTTCAGAATCAATGCCATGGCCTGGTACC GCCAGGCTCCAGGGAAGCAGCGCGAGTTGGTCGCGGAAATTACTG CTGGTGGTAGCACAAACTATGCAGACTCCGTGAAGGGCCGATTCA CCATCTCCGTAGACAACGCCTGGAACACGCTGTATCTGCAAATGAA CAGCCTGAAAGTTGAGGACACGGCCGTCTATTACTGTAATCTAGAT CATTATACGACATGGGATAGACGGAGTGCCTACTGGGGCCAGGGG ACCCTGGTCACGGTCTCCTCCGGAGGCGGTGGGTCAGGTGGCGGA GGCAGCGGTGGAGGAGGTAGTGGCGGTGGCGGTAGTGGGGGTGG AGGCAGCGGAGGCGGAGGCAGTGGGGGCGGTGGATCCGAGGTGC AGTTGGTGGAGTCTGGGGGAGGCTTGGTGCAGGCTGGGGGGTCTC TGAGACTCTCCTGTGCAGCCTCTGGATTCACCTTCAGTAGCTATCC CATGAGCTGGGTCCGCCAGGCTCCAGGAAAGGGGCCCGCGTGGGT CTCAACTGTTAGTCCTGGTGGTATAACCACAAGCTATGCAGACTCC GTGAAGGGCCGATTCACCATCTCCAGAGACAACGCCAAGAACACG CTGTATTTGCAAATGAACAGCCTGAAACCTGAGGACACGGCCGTG TATTACTGCTTAAGAGATCTGAATAATAGGGGCCAGGGGACCCTG GTCACGGTCTCGAGCGGAGGGGGAGGTAGTGGGGGTGGCTCAGAG GTACAACTAGTGGAGTCTGGGGGTGGCTTGGTGCAACCGGGTAAC AGTCTGCGCCTTAGCTGCGCAGCGTCTGGCTTTACCTTCAGCTCCTT TGGCATGAGCTGGGTTCGCCAGGCTCCGGGAAAAGGACTGGAATG GGTTTCGTCTATTAGCGGCAGTGGTAGCGATACGCTCTACGCGGAC TCCGTGAAGGGCCGTTTCACCATCTCCCGCGATAACGCCAAAACTA CACTGTATCTGCAAATGAATAGCCTGCGTCCTGAAGACACGGCCGT TTATTACTGTACTATTGGTGGCTCGTTAAGCCGTTCTTCACAGGGTA CCCTGGTCACCGTCTCCTCA |
| HER3 MS000 30 | 333 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG |

Figure 1 (Continued):

| | | |
|---|---|---|
| | | GGTTATTGTTTATAAATACTACTATTGCCAGCATTGCTGCTAAAGA AGAAGGGGTATCTCTCGAGAAAAGAGAGGTGCAATTGGTGGAGTC TGGGGGAGGCTTGGTGCAGGCTGGGGGGTCTCTGAGACTCTCCTGT GCAGCCTCTGGATTCACCTTCAGTAGCTATCCCATGAGCTGGGTCC GCCAGGCTCCAGGAAAGGGGCCCGCGTGGGTCTCAACTGTTAGTC CTGGTGGTATAACCACAAGCTATGCAGACTCCGTGAAGGGCCGAT TCACCATCTCCAGAGACAACGCCAAGAACACGCTGTATTTGCAAAT GAACAGCCTGAAACCTGAGGACACGGCCGTGTATTACTGCTTAAG AGATCTGAATAATAGGGGCCAGGGGACCCTGGTCACGGTCTCCTC CGGAGGCGGTGGGTCAGGTGGCGGAGGCAGCGGTGGAGGAGGTA GTGGCGGTGGCGGTAGTGGGGGTGGAGGCAGCGGAGGCGGAGGC AGTGGGGGCGGTGGATCCGAGGTGCAGTTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGACTCCTGGG GCCAGGGGACCCTGGTCACGGTCTCGAGCGGAGGGGGAGGTAGTG GGGGTGGCTCAGAGGTACAACTAGTGGAGTCTGGGGGTGGCTTGG TGCAACCGGGTAACAGTCTGCGCCTTAGCTGCGCAGCGTCTGGCTT TACCTTCAGCTCCTTTGGCATGAGCTGGGTTCGCCAGGCTCCGGGA AAAGGACTGGAATGGGTTTCGTCTATTAGCGGCAGTGGTAGCGAT ACGCTCTACGCGGACTCCGTGAAGGGCCGTTTCACCATCTCCCGCG ATAACGCCAAAACTACACTGTATCTGCAAATGAATAGCCTGCGTCC TGAAGACACGGCCGTTTATTACTGTACTATTGGTGGCTCGTTAAGC CGTTCTTCACAGGGTACCCTGGTCACCGTCTCCTCA |
| HER3 MS000 31 | 334 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAAGAGAGGTGCAATTGGTGGAGTC TGGGGGAGGCTTGGTGCAGGCTGGGGGGTCTCTGAGACTCTCCTGT GCAGCCTCTGGATTCACCTTCAGTAGCTATCCCATGAGCTGGGTCC GCCAGGCTCCAGGAAAGGGGCCCGCGTGGGTCTCAACTGTTAGTC CTGGTGGTATAACCACAAGCTATGCAGACTCCGTGAAGGGCCGAT TCACCATCTCCAGAGACAACGCCAAGAACACGCTGTATTTGCAAAT GAACAGCCTGAAACCTGAGGACACGGCCGTGTATTACTGCTTAAG AGATCTGAATAATAGGGGCCAGGGGACCCTGGTCACGGTCTCCTC CGGAGGCGGTGGGTCAGGTGGCGGAGGCAGCGGTGGAGGAGGTA GTGGCGGTGGCGGTAGTGGGGGTGGAGGCAGCGGAGGCGGAGGC AGTGGGGGCGGTGGATCCGAGGTGCAGTTGGTGGAGTCTGGGGGA GGCTTGGTGCAGCCTGGGGGGTCTCTGGGACTCTCCTGTGTAGCCT CTGGAAGCATCTTCAGAATCAATGCCATGGCCTGGTACCGCCAGGC |

Figure 1 (Continued):

| | | |
|---|---|---|
| | | TCCAGGGAAGCAGCGCGAGTTGGTCGCGGAAATTACTGCTGGTGG |
| | | TAGCACAAACTATGCAGACTCCGTGAAGGGCCGATTCACCATCTCC |
| | | GTAGACAACGCCTGGAACACGCTGTATCTGCAAATGAACAGCCTG |
| | | AAAGTTGAGGACACGGCCGTCTATTACTGTAATCTAGATCATTATA |
| | | CGACATGGGATAGACGGAGTGCCTACTGGGGCCAGGGGACCCTGG |
| | | TCACGGTCTCGAGCGGAGGGGGAGGTAGTGGGGGTGGCTCAGAGG |
| | | TACAACTAGTGGAGTCTGGGGGTGGCTTGGTGCAACCGGGTAACA |
| | | GTCTGCGCCTTAGCTGCGCAGCGTCTGGCTTTACCTTCAGCTCCTTT |
| | | GGCATGAGCTGGGTTCGCCAGGCTCCGGGAAAAGGACTGGAATGG |
| | | GTTTCGTCTATTAGCGGCAGTGGTAGCGATACGCTCTACGCGGACT |
| | | CCGTGAAGGGCCGTTTCACCATCTCCCGCGATAACGCCAAAACTAC |
| | | ACTGTATCTGCAAATGAATAGCCTGCGTCCTGAAGACACGGCCGTT |
| | | TATTACTGTACTATTGGTGGCTCGTTAAGCCGTTCTTCACAGGGTA |
| | | CCCTGGTCACCGTCTCCTCA |
| HER3 MS00032 | 335 | ATGAGATTTCCTTCAATTTTTACTGCTGTTTTATTCGCAGCATCCTC |
| | | CGCATTAGCTGCTCCAGTCAACACTACAACAGAAGATGAAACGGC |
| | | ACAAATTCCGGCTGAAGCTGTCATCGGTTACTCAGATTTAGAAGGG |
| | | GATTTCGATGTTGCTGTTTTGCCATTTTCCAACAGCACAAATAACG |
| | | GGTTATTGTTTATAAATACTACTATTGCCAGCATTGCTGCTAAAGA |
| | | AGAAGGGGTATCTCTCGAGAAAAGAGAGGTGCAATTGGTGGAGTC |
| | | TGGGGGAGGCTTGGTGCAGGCTGGGGGGTCTCTGAGACTCTCCTGT |
| | | GCAGCCTCTGGATTCACCTTCAGTAGCTATCCCATGAGCTGGGTCC |
| | | GCCAGGCTCCAGGAAAGGGGCCCGCGTGGGTCTCAACTGTTAGTC |
| | | CTGGTGGTATAACCACAAGCTATGCAGACTCCGTGAAGGGCCGAT |
| | | TCACCATCTCCAGAGACAACGCCAAGAACACGCTGTATTTGCAAAT |
| | | GAACAGCCTGAAACCTGAGGACACGGCCGTGTATTACTGCTTAAG |
| | | AGATCTGAATAATAGGGGCCAGGGGACCCTGGTCACGGTCTCCTC |
| | | CGGAGGCGGTGGGTCAGGTGGCGGAGGCAGCGGTGGAGGAGGTA |
| | | GTGGCGGTGGCGGTAGTGGGGGTGGAGGCAGCGGAGGCGGAGGC |
| | | AGTGGGGGCGGTGGATCCGAGGTGCAGTTGGTGGAGTCTGGGGGA |
| | | GGCTTGGTGCAGGCTGGGGGGTCTCTGAGACTCTCCTGTGCAGCCT |
| | | CTGGATTCACCTTCAGTAGCTATCCCATGAGCTGGGTCCGCCAGGC |
| | | TCCAGGAAAGGGGCCCGCGTGGGTCTCAACTGTTAGTCCTGGTGGT |
| | | ATAACCACAAGCTATGCAGACTCCGTGAAGGGCCGATTCACCATCT |
| | | CCAGAGACAACGCCAAGAACACGCTGTATTTGCAAATGAACAGCC |
| | | TGAAACCTGAGGACACGGCCGTGTATTACTGCTTAAGAGATCTGA |
| | | ATAATAGGGGCCAGGGGACCCTGGTCACGGTCTCGAGCGGAGGGG |
| | | GAGGTAGTGGGGGTGGCTCAGAGGTACAACTAGTGGAGTCTGGGG |
| | | GTGGCTTGGTGCAACCGGGTAACAGTCTGCGCCTTAGCTGCGCAGC |
| | | GTCTGGCTTTACCTTCAGCTCCTTTGGCATGAGCTGGGTTCGCCAG |
| | | GCTCCGGGAAAAGGACTGGAATGGGTTTCGTCTATTAGCGGCAGT |
| | | GGTAGCGATACGCTCTACGCGGACTCCGTGAAGGGCCGTTTCACCA |
| | | TCTCCCGCGATAACGCCAAAACTACACTGTATCTGCAAATGAATAG |
| | | CCTGCGTCCTGAAGACACGGCCGTTTATTACTGTACTATTGGTGGC |
| | | TCGTTAAGCCGTTCTTCACAGGGTACCCTGGTCACCGTCTCCTCA |
| HER3 | 336 | ATGAGATTTCCTTCAATTTTTACTGCTGTTTTATTCGCAGCATCCTC |

Figure 1 (Continued):

| MS000 34 | | CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAGAAAAGAGAGGTGCAATTGGTGGAGTC<br>TGGGGGAGGATTGGTGCAGGCTGGGGGCTCTCTGAGACTCTCCTGT<br>GCAGCCTCTGGACGCACGTACTATCTCAATGCCATGGGCTGGTTCC<br>GCCAGGGTCCAGGGAAGGACCGTGAGTTTGTAGCAGCTATAGACT<br>GGAGTGATGGTAACAAAGACTATGCAGACTCCGTGAAGGGCCGAT<br>TCACCATCTCCAGAGACAACGCCAAGAACACGGTGTATCTGCAAA<br>TGAACAGCCTGAAACCTGAGGACACGGCCGTTTATTACTGTGCAGC<br>CGACACACCACCCTGGGGGCCTATGATCTACATCGAATCGTATGAC<br>TCCTGGGGCCAGGGGACCCTGGTCACGGTCTCCTCCGGAGGCGGT<br>GGGTCAGGTGGCGGAGGCAGCGGTGGAGGAGGTAGTGGCGGTGG<br>CGGTAGTGGGGGTGGAGGCAGCGGAGGCGGAGGCAGTGGGGGCG<br>GTGGATCCGAGGTGCAGTTGGTGGAGTCTGGGGGAGGCTTGGTGC<br>AGCCTGGGGGGTCTCTGAGACTCTCCTGTGCAGCCTCTGGAACGCT<br>CTTCAAAATCAACGCCATGGGCTGGTACCGCCAGGCTCCAGGGAA<br>GCGGCGCGAGTTGGTCGCACTTATTACTAGTAGCGATACAACGGAT<br>TATGCAGAGTCCGTGGAGGGCCGATTCACCATCTCCAGAGACAAC<br>ACGTGGAACGCGGTGTATCTGCAAATGAACAGTCTGAAACCTGAG<br>GATACGGCCGTCTATTACTGTCACTCAGATCATTACTCGATGGGTG<br>TGCCTGAAAAGCGAGTCATAATGTACGGCCAGGGGACCCTGGTCA<br>CGGTCTCGAGCGGAGGGGGAGGTAGTGGGGGTGGCTCAGAGGTAC<br>AACTAGTGGAGTCTGGGGGTGGCTTGGTGCAACCGGGTAACAGTC<br>TGCGCCTTAGCTGCGCAGCGTCTGGCTTTACCTTCAGCTCCTTTGGC<br>ATGAGCTGGGTTCGCCAGGCTCCGGGAAAAGGACTGGAATGGGTT<br>TCGTCTATTAGCGGCAGTGGTAGCGATACGCTCTACGCGGACTCCG<br>TGAAGGGCCGTTTCACCATCTCCCGCGATAACGCCAAAACTACACT<br>GTATCTGCAAATGAATAGCCTGCGTCCTGAAGACACGGCCGTTTAT<br>TACTGTACTATTGGTGGCTCGTTAAGCCGTTCTTCACAGGGTACCC<br>TGGTCACCGTCTCCTCA |
| HER3 MS000 35 | 337 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAGAAAAGAGAGGTGCAATTGGTGGAGTC<br>TGGGGGAGGCTTGGTGCAGGCTGGGGGGTCTCTGAGACTCTCCTGT<br>GCAGCCTCTGGATTCACCTTCAGTAGCTATCCCATGAGCTGGGTCC<br>GCCAGGCTCCAGGAAAGGGGCCCGCGTGGGTCTCAACTGTTAGTC<br>CTGGTGGTATAACCACAAGCTATGCAGACTCCGTGAAGGGCCGAT<br>TCACCATCTCCAGAGACAACGCCAAGAACACGCTGTATTTGCAAAT<br>GAACAGCCTGAAACCTGAGGACACGGCCGTGTATTACTGCTTAAG<br>AGATCTGAATAATAGGGGCCAGGGGACCCTGGTCACGGTCTCCTC<br>CGGAGGCGGTGGGTCAGGTGGCGGAGGCAGCGGTGGAGGAGGTA |

Figure 1 (Continued):

| | | |
|---|---|---|
| | | GTGGCGGTGGCGGTAGTGGGGGTGGAGGCAGCGGAGGCGGAGGC AGTGGGGGCGGTGGATCCGAGGTGCAGTTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGATGGGTGTGCCTGAAAAGCGAGTCATAATGTACGGCCAGGGG ACCCTGGTCACGGTCTCGAGCGGAGGGGGAGGTAGTGGGGGTGGC TCAGAGGTACAACTAGTGGAGTCTGGGGGTGGCTTGGTGCAACCG GGTAACAGTCTGCGCCTTAGCTGCGCAGCGTCTGGCTTTACCTTCA GCTCCTTTGGCATGAGCTGGGTTCGCCAGGCTCCGGGAAAAGGACT GGAATGGGTTTCGTCTATTAGCGGCAGTGGTAGCGATACGCTCTAC GCGGACTCCGTGAAGGGCCGTTTCACCATCTCCCGCGATAACGCCA AAACTACACTGTATCTGCAAATGAATAGCCTGCGTCCTGAAGACAC GGCCGTTTATTACTGTACTATTGGTGGCTCGTTAAGCCGTTCTTCAC AGGGTACCCTGGTCACCGTCTCCTCA |
| HER3 MS000 37 | 338 | ATGAGATTTCCTTCAATTTTTACTGCTGTTTATTCGCAGCATCCTC CGCATTAGCTGCTCCAGTCAACACTACAACAGAAGATGAAACGGC ACAAATTCCGGCTGAAGCTGTCATCGGTTACTCAGATTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGCTTGGTGCAGCCTGGGGGTCTCTGAGACTCTCCTGT GCAGCCTCTGGAACGCTCTTCAAAATCAACGCCATGGGCTGGTACC GCCAGGCTCCAGGGAAGCGGCGCGAGTTGGTCGCACTTATTACTA GTAGCGATACAACGGATTATGCAGAGTCCGTGGAGGGCCGATTCA CCATCTCCAGAGACAACACGTGGAACGCGGTGTATCTGCAAATGA ACAGTCTGAAACCTGAGGATACGGCCGTCTATTACTGTCACTCAGA TCATTACTCGATGGGTGTGCCTGAAAAGCGAGTCATAATGTACGGC CAGGGGACCCTGGTCACGGTCTCCTCCGGAGGCGGTGGGTCAGGT GGCGGAGGCAGCGGTGGAGGAGGTAGTGGCGGTGGCGGTAGTGG GGGTGGAGGCAGCGGAGGCGGAGGCAGTGGGGGCGGTGGATCCG AGGTGCAGTTGGTGGAGTCTGGGGGAGGCTTGGTGCAGCCTGGGG GGTCTCTGAGACTCTCCTGTGCAGCCTCTGGAACGCTCTTCAAAAT CAACGCCATGGGCTGGTACCGCCAGGCTCCAGGGAAGCGGCGCGA GTTGGTCGCACTTATTACTAGTAGCGATACAACGGATTATGCAGAG TCCGTGGAGGGCCGATTCACCATCTCCAGAGACAACACGTGGAAC GCGGTGTATCTGCAAATGAACAGTCTGAAACCTGAGGATACGGCC GTCTATTACTGTCACTCAGATCATTACTCGATGGGTGTGCCTGAAA AGCGAGTCATAATGTACGGCCAGGGGACCCTGGTCACGGTCTCGA GCGGAGGGGGAGGTAGTGGGGGTGGCTCAGAGGTACAACTAGTGG AGTCTGGGGGTGGCTTGGTGCAACCGGGTAACAGTCTGCGCCTTAG CTGCGCAGCGTCTGGCTTTACCTTCAGCTCCTTTGGCATGAGCTGG GTTCGCCAGGCTCCGGGAAAAGGACTGGAATGGGTTTCGTCTATTA |

Figure 1 (Continued):

| | | |
|---|---|---|
| | | GCGGCAGTGGTAGCGATACGCTCTACGCGGACTCCGTGAAGGGCC GTTTCACCATCTCCCGCGATAACGCCAAAACTACACTGTATCTGCA AATGAATAGCCTGCGTCCTGAAGACACGGCCGTTTATTACTGTACT ATTGGTGGCTCGTTAAGCCGTTCTTCACAGGGTACCCTGGTCACCG TCTCCTCA |
| HER3 MS000 38 | 339 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGCTTGGTGCAGCCTGGGGGTCTCTGAGACTCTCCTGT GCAGCCTCTGGAACGCTCTTCAAAATCAACGCCATGGGCTGGTACC GCCAGGCTCCAGGGAAGCGGCGCGAGTTGGTCGCACTTATTACTA GTAGCGATACAACGGATTATGCAGAGTCCGTGGAGGGCCGATTCA CCATCTCCAGAGACAACACGTGGAACGCGGTGTATCTGCAAATGA ACAGTCTGAAACCTGAGGATACGGCCGTCTATTACTGTCACTCAGA TCATTACTCGATGGGTGTGCCTGAAAAGCGAGTCATAATGTACGGC CAGGGGACCCTGGTCACGGTCTCCTCCGGAGGCGGTGGGTCAGGT GGCGGAGGCAGCGGTGGAGGAGGTAGTGGCGGTGGCGGTAGTGG GGGTGGAGGCAGCGGAGGCGGAGGCAGTGGGGGCGGTGGATCCG AGGTGCAGTTGGTGGAGTCTGGGGGAGGATTGGTGCAGGCTGGGG GCTCTCTGAGACTCTCCTGTGCAGCCTCTGGACGCACGTACTATCT CAATGCCATGGGCTGGTTCCGCCAGGGTCCAGGGAAGGACCGTGA GTTTGTAGCAGCTATAGACTGGAGTGATGGTAACAAAGACTATGC AGACTCCGTGAAGGGCCGATTCACCATCTCCAGAGACAACGCCAA GAACACGGTGTATCTGCAAATGAACAGCCTGAAACCTGAGGACAC GGCCGTTTATTACTGTGCAGCCGACACACCACCCTGGGGGCCTATG ATCTACATCGAATCGTATGACTCCTGGGGCCAGGGGACCCTGGTCA CGGTCTCGAGCGGAGGGGGAGGTAGTGGGGGTGGCTCAGAGGTAC AACTAGTGGAGTCTGGGGGTGGCTTGGTGCAACCGGGTAACAGTC TGCGCCTTAGCTGCGCAGCGTCTGGCTTTACCTTCAGCTCCTTTGGC ATGAGCTGGGTTCGCCAGGCTCCGGGAAAAGGACTGGAATGGGTT TCGTCTATTAGCGGCAGTGGTAGCGATACGCTCTACGCGGACTCCG TGAAGGGCCGTTTCACCATCTCCCGCGATAACGCCAAAACTACACT GTATCTGCAAATGAATAGCCTGCGTCCTGAAGACACGGCCGTTTAT TACTGTACTATTGGTGGCTCGTTAAGCCGTTCTTCACAGGGTACCC TGGTCACCGTCTCCTCA |
| HER3 MS000 39 | 340 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGCTTGGTGCAGCCTGGGGGTCTCTGAGACTCTCCTGT GCAGCCTCTGGAACGCTCTTCAAAATCAACGCCATGGGCTGGTACC |

Figure 1 (Continued):

| | | |
|---|---|---|
| | | GCCAGGCTCCAGGGAAGCGGCGCGAGTTGGTCGCACTTATTACTA GTAGCGATACAACGGATTATGCAGAGTCCGTGGAGGGCCGATTCA CCATCTCCAGAGACAACACGTGGAACGCGGTGTATCTGCAAATGA ACAGTCTGAAACCTGAGGATACGGCCGTCTATTACTGTCACTCAGA TCATTACTCGATGGGTGTGCCTGAAAAGCGAGTCATAATGTACGGC CAGGGGACCCTGGTCACGGTCTCCTCCGGAGGCGGTGGGTCAGGT GGCGGAGGCAGCGGTGGAGGAGGTAGTGGCGGTGGCGGTAGTGG GGGTGGAGGCAGCGGAGGCGGAGGCAGTGGGGGCGGTGGATCCG AGGTGCAGTTGGTGGAGTCTGGGGGAGGCTTGGTGCAGGCTGGGG GGTCTCTGAGACTCTCCTGTGCAGCCTCTGGATTCACCTTCAGTAG CTATCCCATGAGCTGGGTCCGCCAGGCTCCAGGAAGGGGCCCGC GTGGGTCTCAACTGTTAGTCCTGGTGGTATAACCACAAGCTATGCA GACTCCGTGAAGGGCCGATTCACCATCTCCAGAGACAACGCCAAG AACACGCTGTATTTGCAAATGAACAGCCTGAAACCTGAGGACACG GCCGTGTATTACTGCTTAAGAGATCTGAATAATAGGGGCCAGGGG ACCCTGGTCACGGTCTCGAGCGGAGGGGGAGGTAGTGGGGGTGGC TCAGAGGTACAACTAGTGGAGTCTGGGGGTGGCTTGGTGCAACCG GGTAACAGTCTGCGCCTTAGCTGCGCAGCGTCTGGCTTTACCTTCA GCTCCTTTGGCATGAGCTGGGTTCGCCAGGCTCCGGGAAAAGGACT GGAATGGGTTCGTCTATTAGCGGCAGTGGTAGCGATACGCTCTAC GCGGACTCCGTGAAGGGCCGTTTCACCATCTCCCGCGATAACGCCA AAACTACACTGTATCTGCAAATGAATAGCCTGCGTCCTGAAGACAC GGCCGTTTATTACTGTACTATTGGTGGCTCGTTAAGCCGTTCTTCAC AGGGTACCCTGGTCACCGTCTCCTCA |
| HER3 MS000 42 | 341 | ATGAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGTCTGCGTCTGAGCTGTGCAGCAA GCGGTTTTACCTTTAGCAGCTATCCGATGAGCTGGGTTCGTCAGGC ACCGGGTAAGGTCCGGCATGGGTTAGCACCGTTAGTCCGGGAGG TATTACCACCAGTTATGCAGATAGCGTTAAAGGTCGTTTTACCATT AGCCGTGACAATAGCAAAAACACCCTGTATCTGCAGATGAATAGC CTGCGTCCTGAAGATACCGCAGTTTATTATTGTCTGCGCGATCTGA ATAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |
| HER3 MS000 43 | 342 | ATGAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTTTTACCTTTAGCAGCTATCCGATGAGCTGGGTTCGTCAGGC ACCGGGTAAGGTCCTGAATGGGTTAGCACCGTTAGTCCGGGAGG TATTACCACCAGTTATGCAGATAGCGTTAAAGGTCGTTTTACCATT AGCCGTGACAATAGCAAAAACACCCTGTATCTGCAGATGAATAGT CTGCGTCCTGAAGATACCGCAGTTTATTATTGTCTGCGCGATCTGA ATAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |

Figure 1 (Continued):

| HER3 MS000 44 | 343 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGTCTGCGTCTGAGCTGTGCAGCAA GCGGTTTTACCTTTAGCAGCTATCCGATGAGCTGGGTTCGTCAGGC ACCGGGTAAAGGTCCGGCATGGGTTAGCACCGTTAGTCCGGGAGG TATTACCACCAGTTATGCAGATAGCGTTAAAGGTCGTTTTACCATT AGCCGTGACAATAGCAAAAACACCCTGTATCTGCAGATGAATAGC CTGCGTCCTGAAGATACCGCAGTTTATTATTGTGCACGCGATCTGA ATAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |
| HER3 MS000 45 | 344 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGTCTGCGTCTGAGCTGTGCAGCAA GCGGTTTTACCTTTAGCAGCTATCCGATGAGCTGGGTTCGTCAGGC ACCGGGTAAAGGTCCTGAATGGGTTAGCACCGTTAGTCCGGGAGG TATTACCACCAGTTATGCAGATAGCGTTAAAGGTCGTTTTACCATT AGCCGTGACAATAGCAAAAACACCCTGTATCTGCAGATGAATAGC CTGCGTCCTGAAGATACCGCAGTTTATTATTGTGCACGCGATCTGA ATAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |
| HER3 MS000 46 | 345 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTCGTACCTATTATCTGAATGCAATGGGTTGGTTTCGTCAGGG TCCGGGTAAAGATCGTGAATTTGTTGCAGCCATTGATTGGAGTGAT GGCAATAAAGATTATGCCGATAGCGTGAAAGGTCGTTTTACCATTA GCCGTGATAACAGCAAAAACACCGTTTATCTGCAGATGAATAGCC TGCGTCCTGAAGATACCGCAGTTTATTATTGTGCAGCAGATACCCC TCCGTGGGGTCCGATGATTTATATTGAAAGCTATGATAGCTGGGGT CAGGGGACCCTGGTCACCGTCTCCTCAGCGGCCGCAGAACAAAAA CTCATCTCAGAAGAGGATCTGAATGGGGCCGCACATCATCATCATC ATCAT |
| HER3 MS000 47 | 346 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTCGTACCTATTATCTGAATGCAATGGGTTGGTTTCGTCAGGC ACCGGGTAAAGATCGTGAATTTGTTGCAGCCATTGATTGGAGTGAT GGCAATAAAGATTATGCCGATAGCGTGAAAGGTCGTTTTACCATTA GCCGTGATAACAGCAAAAACACCGTTTATCTGCAGATGAATAGCC TGCGTCCTGAAGATACCGCAGTTTATTATTGTGCAGCAGATACCCC TCCGTGGGGTCCGATGATTTATATTGAAAGCTATGATAGCTGGGGT CAGGGGACCCTGGTCACCGTCTCCTCAGCGGCCGCAGAACAAAAA CTCATCTCAGAAGAGGATCTGAATGGGGCCGCACATCATCATCATC ATCAT |

Figure 1 (Continued):

| HER3 MS000 48 | 347 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTCGTACCTATTATCTGAATGCAATGGGTTGGTTTCGTCAGGG TCCGGGTAAGAACGTGAATTTGTTGCAGCCATTGATTGGAGTGAT GGCAATAAAGATTATGCCGATAGCGTGAAAGGTCGTTTTACCATTA GCCGTGATAACAGCAAAAACACCGTTTATCTGCAGATGAATAGCC TGCGTCCTGAAGATACCGCAGTTTATTATTGTGCAGCAGATACCCC TCCGTGGGGTCCGATGATTTATATTGAAAGCTATGATAGCTGGGGT CAGGGGACCCTGGTCACCGTCTCCTCAGCGGCCGCAGAACAAAAA CTCATCTCAGAAGAGGATCTGAATGGGGCCGCACATCATCATCATC ATCAT |
| HER3 MS000 49 | 348 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTCGTACCTATTATCTGAATGCAATGGGTTGGTTTCGTCAGGC ACCGGGTAAAGAACGTGAATTTGTTGCAGCCATTGATTGGAGTGAT GGCAATAAAGATTATGCCGATAGCGTGAAAGGTCGTTTTACCATTA GCCGTGATAACAGCAAAAACACCGTTTATCTGCAGATGAATAGCC TGCGTCCTGAAGATACCGCAGTTTATTATTGTGCAGCAGATACCCC TCCGTGGGGTCCGATGATTTATATTGAAAGCTATGATAGCTGGGGT CAGGGGACCCTGGTCACCGTCTCCTCAGCGGCCGCAGAACAAAAA CTCATCTCAGAAGAGGATCTGAATGGGGCCGCACATCATCATCATC ATCAT |
| HER3 MS000 51 | 349 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAAGAGAGGTGCAATTGGTGGAGTC TGGGGGAGGCTTGGTGCAGCCTGGGGGGTCTCTGGGACTCTCCTGT GTAGCCTCTGGAAGCATCTTCAGAATCAATGCCATGGCCTGGTACC GCCAGGCTCCAGGGAAGCAGCGCGAGTTGGTCGCGGAAATTACTG CTGGTGGTAGCACAAACTATGCAGACTCCGTGAAGGGCCGATTCA CCATCTCCGTAGACAACGCCTGGAACACGCTGTATCTGCAAATGAA CAGCCTGAAAGTTGAGGACACGGCCGTCTATTACTGTAATCTAGAT CATTATACGACATGGGATAGACGGAGTGCCTACTGGGGCCAGGGG ACCCTGGTCACGGTCTCCTCCGGAGGCGGTGGGTCAGGTGGCGGA GGCAGCGGTGGAGGAGGTAGTGGCGGTGGCGGTAGTGGGGGTGG AGGCAGCGGAGGCGGAGGCAGTGGGGGCGGTGGATCCGAGGTGC AGTTGGTGGAGTCTGGGGGAGGCTTGGTGCAACCTGGGGGGTCTC TGAGACTCTCCTGCGCAGCCTCTGGAAGCATCGGCGGTCTCAATGC CATGGCCTGGTACCGCCAGGCTCCAGGAAAAGAGCGCGAGTTGGT CGCAGGTATTTTTGGCGTTGGTAGCACGAGGTACGCGGACTCCGTG AAGGGCCGATTCACCATCTCTAGAGACATCGCCAAGAACACGGTG TTTCTGCAAATGAACAGCCTGAATTCTGAGGACACGGCCGTTTATT |

Figure 1 (Continued):

| | | |
|---|---|---|
| | | ACTGTCGGATGTCAAGTGTTACTCGTGGTAGTTCTGACTACTGGGG TCAGGGGACCCTGGTCACGGTCTCGAGCGGAGGGGGAGGTAGTGG GGGTGGCTCAGAGGTACAACTAGTGGAGTCTGGGGGTGGCTTGGT GCAACCGGGTAACAGTCTGCGCCTTAGCTGCGCAGCGTCTGGCTTT ACCTTCAGCTCCTTTGGCATGAGCTGGGTTCGCCAGGCTCCGGGAA AAGGACTGGAATGGGTTTCGTCTATTAGCGGCAGTGGTAGCGATA CGCTCTACGCGGACTCCGTGAAGGGCCGTTTCACCATCTCCCGCGA TAACGCCAAAACTACACTGTATCTGCAAATGAATAGCCTGCGTCCT GAAGACACGGCCGTTTATTACTGTACTATTGGTGGCTCGTTAAGCC GTTCTTCACAGGGTACCCTGGTCACCGTCTCCTCA |
| HER3 MS000 52 | 350 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGCTTGGTGCAGCCTGGGGGGTCTCTGAGACTCTCCTGT GCAGCCTCTGGAACGCTCTTCAAAATCAACGCCATGGGCTGGTACC GCCAGGCTCCAGGGAAGCGGCGCGAGTTGGTCGCACTTATTACTA GTAGCGATACAACGGATTATGCAGAGTCCGTGGAGGGCCGATTCA CCATCTCCAGAGACAACACGTGGAACGCGGTGTATCTGCAAATGA ACAGTCTGAAACCTGAGGATACGGCCGTCTATTACTGTCACTCAGA TCATTACTCGATGGGTGTGCCTGAAAAGCGAGTCATAATGTACGGC CAGGGGACCCTGGTCACGGTCTCCTCCGGAGGCGGTGGGTCAGGT GGCGGAGGCAGCGGTGGAGGAGGTAGTGGCGGTGGCGGTAGTGG GGGTGGAGGCAGCGGAGGCGGAGGCAGTGGGGCGGTGGATCCG AGGTGCAGTTGGTGGAGTCTGGGGGAGGCTTGGTGCAACCTGGGG GGTCTCTGAGACTCTCCTGCGCAGCCTCTGGAAGCATCGGCGGTCT CAATGCCATGGCCTGGTACCGCCAGGCTCCAGGAAAAGAGCGCGA GTTGGTCGCAGGTATTTTTGGCGTTGGTAGCACGAGGTACGCGGAC TCCGTGAAGGGCCGATTCACCATCTCTAGAGACATCGCCAAGAAC ACGGTGTTTCTGCAAATGAACAGCCTGAATTCTGAGGACACGGCC GTTTATTACTGTCGGATGTCAAGTGTTACTCGTGGTAGTTCTGACTA CTGGGGTCAGGGGACCCTGGTCACGGTCTCGAGCGGAGGGGGAGG TAGTGGGGGTGGCTCAGAGGTACAACTAGTGGAGTCTGGGGGTGG CTTGGTGCAACCGGGTAACAGTCTGCGCCTTAGCTGCGCAGCGTCT GGCTTTACCTTCAGCTCCTTTGGCATGAGCTGGGTTCGCCAGGCTC CGGGAAAAGGACTGGAATGGGTTTCGTCTATTAGCGGCAGTGGTA GCGATACGCTCTACGCGGACTCCGTGAAGGGCCGTTTCACCATCTC CCGCGATAACGCCAAAACTACACTGTATCTGCAAATGAATAGCCT GCGTCCTGAAGACACGGCCGTTTATTACTGTACTATTGGTGGCTCG TTAAGCCGTTCTTCACAGGGTACCCTGGTCACCGTCTCCTCA |
| HER3 MS000 54 | 351 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG |

Figure 1 (Continued):

| | | |
|---|---|---|
| | | GGTTATTGTTTATAAATACTACTATTGCCAGCATTGCTGCTAAAGA<br>AGAAGGGGTATCTCTCGAGAAAAGAGAGGTGCAATTGGTGGAGTC<br>TGGGGGAGGCTTGGTGCAACCTGGGGGGTCTCTGAGACTCTCCTGC<br>GCAGCCTCTGGAAGCATCGGCGGTCTCAATGCCATGGCCTGGTACC<br>GCCAGGCTCCAGGAAAAGAGCGCGAGTTGGTCGCAGGTATTTTTG<br>GCGTTGGTAGCACGAGGTACGCGGACTCCGTGAAGGGCCGATTCA<br>CCATCTCTAGAGACATCGCCAAGAACACGGTGTTTCTGCAAATGAA<br>CAGCCTGAATTCTGAGGACACGGCCGTTTATTACTGTCGGATGTCA<br>AGTGTTACTCGTGGTAGTTCTGACTACTGGGGTCAGGGGACCCTGG<br>TCACGGTCTCCTCCGGAGGCGGTGGGTCAGGTGGCGGAGGCAGCG<br>GTGGAGGAGGTAGTGGCGGTGGCGGTAGTGGGGGTGGAGGCAGC<br>GGAGGCGGAGGCAGTGGGGGCGGTGGATCCGAGGTGCAGTTGGTG<br>GAGTCTGGGGGAGGCTTGGTGCAGCCTGGGGGGTCTCTGGGACTC<br>TCCTGTGTAGCCTCTGGAAGCATCTTCAGAATCAATGCCATGGCCT<br>GGTACCGCCAGGCTCCAGGGAAGCAGCGCGAGTTGGTCGCGGAAA<br>TTACTGCTGGTGGTAGCACAAACTATGCAGACTCCGTGAAGGGCC<br>GATTCACCATCTCCGTAGACAACGCCTGGAACACGCTGTATCTGCA<br>AATGAACAGCCTGAAAGTTGAGGACACGGCCGTCTATTACTGTAA<br>TCTAGATCATTATACGACATGGGATAGACGGAGTGCCTACTGGGG<br>CCAGGGGACCCTGGTCACGGTCTCGAGCGGAGGGGGAGGTAGTGG<br>GGGTGGCTCAGAGGTACAACTAGTGGAGTCTGGGGGTGGCTTGGT<br>GCAACCGGGTAACAGTCTGCGCCTTAGCTGCGCAGCGTCTGGCTTT<br>ACCTTCAGCTCCTTTGGCATGAGCTGGGTTCGCCAGGCTCCGGGAA<br>AAGGACTGGAATGGGTTTCGTCTATTAGCGGCAGTGGTAGCGATA<br>CGCTCTACGCGGACTCCGTGAAGGGCCGTTTCACCATCTCCCGCGA<br>TAACGCCAAAACTACACTGTATCTGCAAATGAATAGCCTGCGTCCT<br>GAAGACACGGCCGTTTATTACTGTACTATTGGTGGCTCGTTAAGCC<br>GTTCTTCACAGGGTACCCTGGTCACCGTCTCCTCA |
| HER3<br>MS000<br>55 | 352 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAGAAAAGAGAGGTGCAATTGGTGGAGTC<br>TGGGGGAGGCTTGGTGCAGGCTGGGGGGTCTCTGAGACTCTCCTGT<br>GCAGCCTCTGGATTCACCTTCAGTAGCTATCCCATGAGCTGGGTCC<br>GCCAGGCTCCAGGAAAGGGGCCCGCGTGGGTCTCAACTGTTAGTC<br>CTGGTGGTATAACCACAAGCTATGCAGACTCCGTGAAGGGCCGAT<br>TCACCATCTCCAGAGACAACGCCAAGAACACGCTGTATTTGCAAAT<br>GAACAGCCTGAAACCTGAGGACACGGCCGTGTATTACTGCTTAAG<br>AGATCTGAATAATAGGGGCCAGGGGACCCTGGTCACGGTCTCCTC<br>CGGAGGCGGTGGGTCAGGTGGCGGAGGCAGCGGTGGAGGAGGTA<br>GTGGCGGTGGCGGTAGTGGGGGTGGAGGCAGCGGAGGCGGAGGC<br>AGTGGGGGCGGTGGATCCGAGGTGCAGTTGGTGGAGTCTGGGGGA<br>GGCTTGGTGCAACCTGGGGGGTCTCTGAGACTCTCCTGCGCAGCCT<br>CTGGAAGCATCGGCGGTCTCAATGCCATGGCCTGGTACCGCCAGG |

Figure 1 (Continued):

| | | |
|---|---|---|
| | | CTCCAGGAAAAGAGCGCGAGTTGGTCGCAGGTATTTTTGGCGTTGG TAGCACGAGGTACGCGGACTCCGTGAAGGGCCGATTCACCATCTCT AGAGACATCGCCAAGAACACGGTGTTTCTGCAAATGAACAGCCTG AATTCTGAGGACACGGCCGTTTATTACTGTCGGATGTCAAGTGTTA CTCGTGGTAGTTCTGACTACTGGGGTCAGGGGACCCTGGTCACGGT CTCGAGCGGAGGGGGAGGTAGTGGGGGTGGCTCAGAGGTACAACT AGTGGAGTCTGGGGGTGGCTTGGTGCAACCGGGTAACAGTCTGCG CCTTAGCTGCGCAGCGTCTGGCTTTACCTTCAGCTCCTTTGGCATGA GCTGGGTTCGCCAGGCTCCGGGAAAAGGACTGGAATGGGTTTCGT CTATTAGCGGCAGTGGTAGCGATACGCTCTACGCGGACTCCGTGAA GGGCCGTTTCACCATCTCCCGCGATAACGCCAAAACTACACTGTAT CTGCAAATGAATAGCCTGCGTCCTGAAGACACGGCCGTTTATTACT GTACTATTGGTGGCTCGTTAAGCCGTTCTTCACAGGGTACCCTGGT CACCGTCTCCTCA |
| HER3 MS000 56 | 353 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGAGGCTTGGTGCAACCTGGGGGTCTCTGAGACTCTCCTGC GCAGCCTCTGGAAGCATCGGCGGTCTCAATGCCATGGCCTGGTACC GCCAGGCTCCAGGAAAAGAGCGCGAGTTGGTCGCAGGTATTTTTG GCGTTGGTAGCACGAGGTACGCGGACTCCGTGAAGGGCCGATTCA CCATCTCTAGAGACATCGCCAAGAACACGGTGTTTCTGCAAATGAA CAGCCTGAATTCTGAGGACACGGCCGTTTATTACTGTCGGATGTCA AGTGTTACTCGTGGTAGTTCTGACTACTGGGGTCAGGGGACCCTGG TCACGGTCTCCTCCGGAGGCGGTGGGTCAGGTGGCGGAGGCAGCG GTGGAGGAGGTAGTGGCGGTGGCGGTAGTGGGGGTGGAGGCAGC GGAGGCGGAGGCAGTGGGGCGGTGGATCCGAGGTGCAGTTGGTG GAGTCTGGGGGAGGCTTGGTGCAACCTGGGGGTCTCTGAGACTC TCCTGCGCAGCCTCTGGAAGCATCGGCGGTCTCAATGCCATGGCCT GGTACCGCCAGGCTCCAGGAAAAGAGCGCGAGTTGGTCGCAGGTA TTTTTGGCGTTGGTAGCACGAGGTACGCGGACTCCGTGAAGGGCCG ATTCACCATCTCTAGAGACATCGCCAAGAACACGGTGTTTCTGCAA ATGAACAGCCTGAATTCTGAGGACACGGCCGTTTATTACTGTCGGA TGTCAAGTGTTACTCGTGGTAGTTCTGACTACTGGGGTCAGGGGAC CCTGGTCACGGTCTCGAGCGGAGGGGGAGGTAGTGGGGGTGGCTC AGAGGTACAACTAGTGGAGTCTGGGGGTGGCTTGGTGCAACCGGG TAACAGTCTGCGCCTTAGCTGCGCAGCGTCTGGCTTTACCTTCAGC TCCTTTGGCATGAGCTGGGTTCGCCAGGCTCCGGGAAAAGGACTG GAATGGGTTTCGTCTATTAGCGGCAGTGGTAGCGATACGCTCTACG CGGACTCCGTGAAGGGCCGTTTCACCATCTCCCGCGATAACGCCAA AACTACACTGTATCTGCAAATGAATAGCCTGCGTCCTGAAGACACG GCCGTTTATTACTGTACTATTGGTGGCTCGTTAAGCCGTTCTTCACA GGGTACCCTGGTCACCGTCTCCTCA |

Figure 1 (Continued):

| HER3 MS000 57 | 354 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAAGAGAGGTGCAATTGGTGGAGTC TGGGGGAGGCTTGGTGCAACCTGGGGGGTCTCTGAGACTCTCCTGC GCAGCCTCTGGAAGCATCGGCGGTCTCAATGCCATGGCCTGGTACC GCCAGGCTCCAGGAAAAGAGCGCGAGTTGGTCGCAGGTATTTTTG GCGTTGGTAGCACGAGGTACGCGGACTCCGTGAAGGGCCGATTCA CCATCTCTAGAGACATCGCCAAGAACACGGTGTTTCTGCAAATGAA CAGCCTGAATTCTGAGGACACGGCCGTTTATTACTGTCGGATGTCA AGTGTTACTCGTGGTAGTTCTGACTACTGGGGTCAGGGGACCCTGG TCACGGTCTCCTCCGGAGGCGGTGGGTCAGGTGGCGGAGGCAGCG GTGGAGGAGGTAGTGGCGGTGGCGGTAGTGGGGGTGGAGGCAGC GGAGGCGGAGGCAGTGGGGGCGGTGGATCCGAGGTGCAGTTGGTG GAGTCTGGGGGAGGCTTGGTGCAGGCTGGGGGTCTCTGAGACTC TCCTGTGCAGCCTCTGGATTCACCTTCAGTAGCTATCCCATGAGCT GGGTCCGCCAGGCTCCAGGAAAGGGGCCCGCGTGGGTCTCAACTG TTAGTCCTGGTGGTATAACCACAAGCTATGCAGACTCCGTGAAGGG CCGATTCACCATCTCCAGAGACAACGCCAAGAACACGCTGTATTTG CAAATGAACAGCCTGAAACCTGAGGACACGGCCGTGTATTACTGC TTAAGAGATCTGAATAATAGGGGCCAGGGGACCCTGGTCACGGTC TCGAGCGGAGGGGGAGGTAGTGGGGGTGGCTCAGAGGTACAACTA GTGGAGTCTGGGGGTGGCTTGGTGCAACCGGGTAACAGTCTGCGC CTTAGCTGCGCAGCGTCTGGCTTTACCTTCAGCTCCTTTGGCATGA GCTGGGTTCGCCAGGCTCCGGGAAAAGGACTGGAATGGGTTTCGT CTATTAGCGGCAGTGGTAGCGATACGCTCTACGCGGACTCCGTGAA GGGCCGTTTCACCATCTCCCGCGATAACGCCAAAACTACACTGTAT CTGCAAATGAATAGCCTGCGTCCTGAAGACACGGCCGTTTATTACT GTACTATTGGTGGCTCGTTAAGCCGTTCTTCACAGGGTACCCTGGT CACCGTCTCCTCA |
| HER3 MS000 58 | 355 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAAGAGAGGTGCAATTGGTGGAGTC TGGGGGAGGCTTGGTGCAACCTGGGGGGTCTCTGAGACTCTCCTGC GCAGCCTCTGGAAGCATCGGCGGTCTCAATGCCATGGCCTGGTACC GCCAGGCTCCAGGAAAAGAGCGCGAGTTGGTCGCAGGTATTTTTG GCGTTGGTAGCACGAGGTACGCGGACTCCGTGAAGGGCCGATTCA CCATCTCTAGAGACATCGCCAAGAACACGGTGTTTCTGCAAATGAA CAGCCTGAATTCTGAGGACACGGCCGTTTATTACTGTCGGATGTCA AGTGTTACTCGTGGTAGTTCTGACTACTGGGGTCAGGGGACCCTGG TCACGGTCTCCTCCGGAGGCGGTGGGTCAGGTGGCGGAGGCAGCG |

Figure 1 (Continued):

| | | |
|---|---|---|
| | | GTGGAGGAGGTAGTGGCGGTGGCGGTAGTGGGGGTGGAGGCAGC<br>GGAGGCGGAGGCAGTGGGGGCGGTGGATCCGAGGTGCAGTTGGTG<br>GAGTCTGGGGGAGGCTTGGTGCAGCCTGGGGGGTCTCTGAGACTC<br>TCCTGTGCAGCCTCTGGAACGCTCTTCAAAATCAACGCCATGGGCT<br>GGTACCGCCAGGCTCCAGGGAAGCGGCGCGAGTTGGTCGCACTTA<br>TTACTAGTAGCGATACAACGGATTATGCAGAGTCCGTGGAGGGCC<br>GATTCACCATCTCCAGAGACAACACGTGGAACGCGGTGTATCTGC<br>AAATGAACAGTCTGAAACCTGAGGATACGGCCGTCTATTACTGTCA<br>CTCAGATCATTACTCGATGGGTGTGCCTGAAAAGCGAGTCATAATG<br>TACGGCCAGGGGACCCTGGTCACGGTCTCGAGCGGAGGGGGAGGT<br>AGTGGGGGTGGCTCAGAGGTACAACTAGTGGAGTCTGGGGGTGGC<br>TTGGTGCAACCGGGTAACAGTCTGCGCCTTAGCTGCGCAGCGTCTG<br>GCTTTACCTTCAGCTCCTTTGGCATGAGCTGGGTTCGCCAGGCTCC<br>GGGAAAAGGACTGGAATGGGTTTCGTCTATTAGCGGCAGTGGTAG<br>CGATACGCTCTACGCGGACTCCGTGAAGGGCCGTTTCACCATCTCC<br>CGCGATAACGCCAAAACTACACTGTATCTGCAAATGAATAGCCTG<br>CGTCCTGAAGACACGGCCGTTTATTACTGTACTATTGGTGGCTCGT<br>TAAGCCGTTCTTCACAGGGTACCCTGGTCACCGTCTCCTCA |
| HER3<br>MS000<br>60 | 356 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAGAAAAGAGAGGTGCAATTGGTGGAGTC<br>TGGGGGAGGATTGGTGCAGGCTGGGGGCTCTCTGAGACTCTCCTGT<br>GCAGCCTCTGGACGCACGTACTATCTCAATGCCATGGGCTGGTTCC<br>GCCAGGGTCCAGGGAAGGACCGTGAGTTTGTAGCAGCTATAGACT<br>GGAGTGATGGTAACAAAGACTATGCAGACTCCGTGAAGGGCCGAT<br>TCACCATCTCCAGAGACAACGCCAAGAACACGGTGTATCTGCAAA<br>TGAACAGCCTGAAACCTGAGGACACGGCCGTTTATTACTGTGCAGC<br>CGACACACCACCCTGGGGGCCTATGATCTACATCGAATCGTATGAC<br>TCCTGGGGCCAGGGGACCCTGGTCACGGTCTCCTCCGGAGGCGGT<br>GGGTCAGGTGGCGGAGGCAGCGGTGGAGGAGGTAGTGGCGGTGG<br>CGGTAGTGGGGGTGGAGGCAGCGGAGGCGGAGGCAGTGGGGGCG<br>GTGGATCCGAGGTGCAGTTGGTGGAGTCTGGGGGAGGCTTGGTGC<br>AACCTGGGGGGTCTCTGAGACTCTCCTGCGCAGCCTCTGGAAGCAT<br>CGGCGGTCTCAATGCCATGGCCTGGTACCGCCAGGCTCCAGGAAA<br>AGAGCGCGAGTTGGTCGCAGGTATTTTGGCGTTGGTAGCACGAG<br>GTACGCGGACTCCGTGAAGGGCCGATTCACCATCTCTAGAGACATC<br>GCCAAGAACACGGTGTTTCTGCAAATGAACAGCCTGAATTCTGAG<br>GACACGGCCGTTTATTACTGTCGGATGTCAAGTGTTACTCGTGGTA<br>GTTCTGACTACTGGGGTCAGGGGACCCTGGTCACGGTCTCGAGCGG<br>AGGGGGAGGTAGTGGGGGTGGCTCAGAGGTACAACTAGTGGAGTC<br>TGGGGGTGGCTTGGTGCAACCGGGTAACAGTCTGCGCCTTAGCTGC<br>GCAGCGTCTGGCTTTACCTTCAGCTCCTTTGGCATGAGCTGGGTTC<br>GCCAGGCTCCGGGAAAAGGACTGGAATGGGTTTCGTCTATTAGCG |

Figure 1 (Continued):

| | | |
|---|---|---|
| | | GCAGTGGTAGCGATACGCTCTACGCGGACTCCGTGAAGGGCCGTTT<br>CACCATCTCCCGCGATAACGCCAAAACTACACTGTATCTGCAAATG<br>AATAGCCTGCGTCCTGAAGACACGGCCGTTTATTACTGTACTATTG<br>GTGGCTCGTTAAGCCGTTCTTCACAGGGTACCCTGGTCACCGTCTC<br>CTCA |
| HER3<br>MS000<br>61 | 357 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAGAAAGAGAGGTGCAATTGGTGGAGTC<br>TGGGGGAGGCTTGGTGCAACCTGGGGGGTCTCTGAGACTCTCCTGC<br>GCAGCCTCTGGAAGCATCGGCGGTCTCAATGCCATGGCCTGGTACC<br>GCCAGGCTCCAGGAAAAGAGCGCGAGTTGGTCGCAGGTATTTTTG<br>GCGTTGGTAGCACGAGGTACGCGGACTCCGTGAAGGGCCGATTCA<br>CCATCTCTAGAGACATCGCCAAGAACACGGTGTTTCTGCAAATGAA<br>CAGCCTGAATTCTGAGGACACGGCCGTTTATTACTGTCGGATGTCA<br>AGTGTTACTCGTGGTAGTTCTGACTACTGGGGTCAGGGGACCCTGG<br>TCACGGTCTCCTCCGGAGGCGGTGGGTCAGGTGGCGGAGGCAGCG<br>GTGGAGGAGGTAGTGGCGGTGGCGGTAGTGGGGGTGGAGGCAGC<br>GGAGGCGGAGGCAGTGGGGGCGGTGGATCCGAGGTGCAGTTGGTG<br>GAGTCTGGGGGAGGATTGGTGCAGGCTGGGGGCTCTCTGAGACTC<br>TCCTGTGCAGCCTCTGGACGCACGTACTATCTCAATGCCATGGGCT<br>GGTTCCGCCAGGGTCCAGGGAAGGACCGTGAGTTTGTAGCAGCTA<br>TAGACTGGAGTGATGGTAACAAAGACTATGCAGACTCCGTGAAGG<br>GCCGATTCACCATCTCCAGAGACAACGCCAAGAACACGGTGTATC<br>TGCAAATGAACAGCCTGAAACCTGAGGACACGGCCGTTTATTACT<br>GTGCAGCCGACACACCACCCTGGGGGCCTATGATCTACATCGAATC<br>GTATGACTCCTGGGGCCAGGGGACCCTGGTCACGGTCTCGAGCGG<br>AGGGGGAGGTAGTGGGGGTGGCTCAGAGGTACAACTAGTGGAGTC<br>TGGGGGTGGCTTGGTGCAACCGGGTAACAGTCTGCGCCTTAGCTGC<br>GCAGCGTCTGGCTTTACCTTCAGCTCCTTTGGCATGAGCTGGGTTC<br>GCCAGGCTCCGGGAAAAGGACTGGAATGGGTTTCGTCTATTAGCG<br>GCAGTGGTAGCGATACGCTCTACGCGGACTCCGTGAAGGGCCGTTT<br>CACCATCTCCCGCGATAACGCCAAAACTACACTGTATCTGCAAATG<br>AATAGCCTGCGTCCTGAAGACACGGCCGTTTATTACTGTACTATTG<br>GTGGCTCGTTAAGCCGTTCTTCACAGGGTACCCTGGTCACCGTCTC<br>CTCA |
| HER3<br>MS000<br>68 | 358 | ATGAAAAAGACCGCTATCGCGATTGCAGTGGCACTGGCTGGTTTG<br>GCCACCGTGGCCCAGGCCGAGGTGCAATTGGTGGAGTCTGGGGGA<br>GGCTTGGTGCAGCCTGGGGGGTCTCTGAGACTCTCCTGTGCAGCCT<br>CTGGAACGCTCTTCAAAATCAACGCCATGGGCTGGTACCGCCAGG<br>CTCCAGGGAAGCGGCGCGAGTTGGTCGCACTTATTACTAGTAGCG<br>ATACAACGGATTATGCAGAGTCCGTGGAGGGCCGATTCACCATCTC<br>CAGAGACAACACGTGGAACGCGGTGTATCTGCAAATGAACAGTCT<br>GAAACCTGAGGATACGGCCGTCTATTACTGTCACTCAGATCATTAC |

Figure 1 (Continued):

| | | |
|---|---|---|
| | | TCGGGTGGTGTGCCTGAAAAGCGAGTCATAATGTACGGCCAGGGG ACCCTGGTCACCGTCTCCTCAGCGGCCGCAGAACAAAAACTCATCT CAGAAGAGGATCTGAATGGGGCCGCACATCATCATCATCATCAT |
| HER3 MS000 69 | 359 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGTTGGGTGTGCCTGAAAAGCGAGTCATAATGTACGGCCAGGGG ACCCTGGTCACCGTCTCCTCAGCGGCCGCAGAACAAAAACTCATCT CAGAAGAGGATCTGAATGGGGCCGCACATCATCATCATCATCAT |
| HER3 MS000 70 | 360 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGATTGGTGTGCCTGAAAAGCGAGTCATAATGTACGGCCAGGGG ACCCTGGTCACCGTCTCCTCAGCGGCCGCAGAACAAAAACTCATCT CAGAAGAGGATCTGAATGGGGCCGCACATCATCATCATCATCAT |
| HER3 MS000 71 | 361 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGGTTGGTGTGCCTGAAAAGCGAGTCATAATGTACGGCCAGGGG ACCCTGGTCACCGTCTCCTCAGCGGCCGCAGAACAAAAACTCATCT CAGAAGAGGATCTGAATGGGGCCGCACATCATCATCATCATCAT |
| HER3 MS000 72 | 362 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGATGGGTGTGCCTGAAAAGCGAGTCATACTGTACGGCCAGGGG ACCCTGGTCACCGTCTCCTCAGCGGCCGCAGAACAAAAACTCATCT |

Figure 1 (Continued):

| | | |
|---|---|---|
| | | CAGAAGAGGATCTGAATGGGGCCGCACATCATCATCATCAT |
| HER3 MS000 73 | 363 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGATGGGTGTGCCTGAAAAGCGAGTCATAGATTACGGCCAGGGG ACCCTGGTCACCGTCTCCTCAGCGGCCGCAGAACAAAAACTCATCT CAGAAGAGGATCTGAATGGGGCCGCACATCATCATCATCAT |
| HER3 MS000 74 | 364 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGATGGGTGTGCCTGAAAAGCGAGTCATAGAGTACGGCCAGGGG ACCCTGGTCACCGTCTCCTCAGCGGCCGCAGAACAAAAACTCATCT CAGAAGAGGATCTGAATGGGGCCGCACATCATCATCATCAT |
| HER3 MS000 76 | 365 | ATGAAAAAGACCGCTATCGCGATTGCAGTGGCACTGGCTGGTTTG GCCACCGTGGCCCAGGCCGAGGTGCAATTGGTGGAGTCTGGGGGT GGCCTGGTTCAGCCGGGTGGTAGCCTGCGTCTGTCTTGCGCGGCTA GCGGTAGCATTGGCGGCCTGAACGCGATGGCATGGTACCGCCAAG CACCGGGTAAAGAGCGCGAATTGGTTGCCGGCATCTTTGGCGTCG GTAGCACCCGTTACGCGGACAGCGTCAAAGGTCGTTTCACCATTTC GCGCGATATCTCCAAGAATACCGTTTTCCTGCAAATGAACAGCCTG CGTAGCGAGGACACGGCGGTGTACTATTGTCGTATGAGCTCCGTGA CGCGTGGTAGCAGCGATTATTGGGGCCAGGGGACCCTGGTCACCG TCTCCTCAGCGGCCGCAGAACAAAAACTCATCTCAGAAGAGGATC TGAATGGGGCCGCACATCATCATCATCAT |
| HER3 MS000 77 | 366 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGATAATAGCAAAAATACCGTGTTTCTGCAGATGAATAGCCTGCG TAGCGAAGATACCGCAGTTTATTATTGTCGTATGAGCAGCGTTACC CGTGGTAGCAGCGATTATTGGGGTCAGGGGACCCTGGTCACCGTCT CCTCAGCGGCCGCAGAACAAAAACTCATCTCAGAAGAGGATCTGA ATGGGGCCGCACATCATCATCATCAT |
| HER3 | 367 | ATGAAAAAGACCGCTATCGCGATTGCAGTGGCACTGGCTGGTTTG |

Figure 1 (Continued):

| | | |
|---|---|---|
| MS000 78 | | GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGATATTAGCAAAAATACCGTGTATCTGCAGATGAATAGCCTGCG TAGCGAAGATACCGCAGTTTATTATTGTCGTATGAGCAGCGTTACC CGTGGTAGCAGCGATTATTGGGGTCAGGGGACCCTGGTCACCGTCT CCTCAGCGGCCGCAGAACAAAAACTCATCTCAGAAGAGGATCTGA ATGGGGCCGCACATCATCATCATCATCAT |
| HER3 MS000 79 | 368 | ATGAAAAAGACCGCTATCGCGATTGCAGTGGCACTGGCTGGTTTG GCCACCGTGGCCCAGGCCGAGGTGCAATTGGTGGAGTCTGGGGGT GGCCTGGTTCAACCGGGTGGTAGCCTGCGCCTGTCCTGCGCAGCTT CGGGTAGCATTGGTGGCTTGAATGCCATGGCGTGGTACCGTCAGGC ACCGGGTAAAGAGCGTGAACTGGTGGCCGGCATCTTCGGCGTTGG TAGCACGCGCTATGCGGACTCCGTGAAGGGCCGTTTCACCATTAGC CGTGACATCAGCAAAAACACCGTTTTTCTGCAGATGAACAGCCTGC GTAGCGAGGATACGGCGGTCTACTACTGTGCGATGAGCTCTGTCAC CGCGGTAGCAGCGATTATTGGGGCCAAGGGACCCTGGTCACCGT CTCCTCAGCGGCCGCAGAACAAAAACTCATCTCAGAAGAGGATCT GAATGGGGCCGCACATCATCATCATCAT |
| HER3 MS000 80 | 369 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGATAATAGCAAAAATACCGTGTATCTGCAGATGAATAGCCTGC GTAGCGAAGATACCGCAGTTTATTATTGTCGTATGAGCAGCGTTAC CCGTGGTAGCAGCGATTATTGGGGTCAGGGGACCCTGGTCACCGTC TCCTCAGCGGCCGCAGAACAAAAACTCATCTCAGAAGAGGATCTG AATGGGGCCGCACATCATCATCATCAT |
| HER3 MS000 81 | 370 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGATAATAGCAAAAATACCGTGTTTCTGCAGATGAATAGCCTGCG TAGCGAAGATACCGCAGTTTATTATTGTGCAATGAGCAGCGTTACC CGTGGTAGCAGCGATTATTGGGGTCAGGGGACCCTGGTCACCGTCT CCTCAGCGGCCGCAGAACAAAAACTCATCTCAGAAGAGGATCTGA ATGGGGCCGCACATCATCATCATCATCAT |
| HER3 MS000 82 | 371 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA |

Figure 1 (Continued):

| | | |
|---|---|---|
| | | GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGATATTAGCAAAAATACCGTGTATCTGCAGATGAATAGCCTGCG TAGCGAAGATACCGCAGTTTATTATTGTGCAATGAGCAGCGTTACC CGTGGTAGCAGCGATTATTGGGGTCAGGGGACCCTGGTCACCGTCT CCTCAGCGGCCGCAGAACAAAAACTCATCTCAGAAGAGGATCTGA ATGGGGCCGCACATCATCATCATCATCAT |
| HER3 MS000 83 | 372 | ATGAAAAAGACCGCTATCGCGATTGCAGTGGCACTGGCTGGTTTG GCCACCGTGGCCCAGGCCGAGGTGCAATTGGTGGAGTCTGGGGGT GGCCTGGTTCAACCGGGTGGTAGCCTGCGCCTGAGCTGCGCAGCG AGCGGTAGCATTGGCGGCCTGAACGCGATGGCCTGGTATCGCCAG GCACCGGGCAAAGAGCGTGAATTGGTTGCCGGCATCTTTGGTGTG GGCAGCACCCGTTACGCTGACTCTGTCAAAGGTCGCTTCACGATCA GCCGTGATAACAGCAAGAATACCGTGTACCTGCAAATGAATTCGC TGCGTAGCGAGGACACGGCGGTTTACTATTGTGCGATGTCCAGCGT CACCCGTGGTTCCAGCGATTATTGGGGTCAGGGGACCCTGGTCACC GTCTCCTCAGCGGCCGCAGAACAAAAACTCATCTCAGAAGAGGAT CTGAATGGGGCCGCACATCATCATCATCATCAT |
| HER3 MS000 84 | 373 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGATATTAGCAAAAATACCGTGTTTCTGCAGATGAATAGCCTGCG TCCAGAAGATACCGCAGTTTATTATTGTCGTATGAGCAGCGTTACC CGTGGTAGCAGCGATTATTGGGGTCAGGGGACCCTGGTCACCGTCT CCTCAGCGGCCGCAGAACAAAAACTCATCTCAGAAGAGGATCTGA ATGGGGCCGCACATCATCATCATCATCAT |
| HER3 MS000 85 | 374 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGATATTAGCAAAAATACCGTGTTTCTGCAGATGAATAGCCTGCG TGCGGAAGATACCGCAGTTTATTATTGTCGTATGAGCAGCGTTACC CGTGGTAGCAGCGATTATTGGGGTCAGGGGACCCTGGTCACCGTCT CCTCAGCGGCCGCAGAACAAAAACTCATCTCAGAAGAGGATCTGA ATGGGGCCGCACATCATCATCATCATCAT |
| HER3 MS000 88 | 375 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTTA |

Figure 1 (Continued):

| | | |
|---|---|---|
| | | TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGACTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 89 | 376 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA GGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGACTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 90 | 377 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGCGAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGACTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 91 | 378 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTTTTATCTACATCGAATCGTATGACTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 92 | 379 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGCTCTCTGAGACTCTCCTGTGCAGCCT |

Figure 1 (Continued):

| | | |
|---|---|---|
| | | CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTTATATCTACATCGAATCGTATGACTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 93 | 380 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTCTTATCTACATCGAATCGTATGACTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 94 | 381 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATCAGTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 95 | 382 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGAGTCCTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 | 383 | ATGAAAAAGACCGCTATCGCGATTGCAGTGGCACTGGCTGGTTTG |

Figure 1 (Continued):

| | | |
|---|---|---|
| MS000 96 | | GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGACGATTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 97 | 384 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGACGAGTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS000 98 | 385 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA CCACCCTGGGGGCCTATGATCTACATCGAATCGTATGACACGTGGG GCCAGGGGACCCTGGTCACCGTCTCCTCAGCGGCCGCAGAACAAA AACTCATCTCAGAAGAGGATCTGAATGGGGCCGCACATCATCATC ATCATCAT |
| HER3 MS001 18 | 386 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGACAATAGCAAAAACACCGTTTATCTGCAGATGAATAGCCTGC GTGCAGAAGATACCGCAGTTTATTATTGTCGCATGAGCAGCGTTAC CCGTGGTAGCAGCGATTATTGGGGTCAGGGGACCCTGGTCACCGTC TCCTCAGCGGCCGCAGAACAAAAACTCATCTCAGAAGAGGATCTG AATGGGGCCGCACATCATCATCATCATCAT |

Figure 1 (Continued):

| HER3 MS001 19 | 387 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGACAATAGCAAAAACACCGTTTATCTGCAGATGAATAGCCTGC GTCCTGAAGATACCGCAGTTTATTATTGTCGCATGAGCAGCGTTAC CCGTGGTAGCAGCGATTATTGGGGTCAGGGGACCCTGGTCACCGTC TCCTCAGCGGCCGCAGAACAAAAACTCATCTCAGAAGAGGATCTG AATGGGGCCGCACATCATCATCATCATCAT |
| HER3 MS001 20 | 388 | ATGAAAAAGACCGCTATCGCGATTGCAGTGGCACTGGCTGGTTTG GCCACCGTGGCCCAGGCCGACGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGACAATAGCAAAAACACCGTTTATCTGCAGATGAATAGCCTGC GTGCAGAAGATACCGCAGTTTATTATTGTCGCATGAGCAGCGTTAC CCGTGGTAGCAGCGATTATTGGGGTCAGGGGACCCTGGTCACCGTC TCCTCAGCGGCCGCAGAACAAAAACTCATCTCAGAAGAGGATCTG AATGGGGCCGCACATCATCATCATCATCAT |
| HER3 MS001 21 | 389 | ATGAAAAAGACCGCTATCGCGATTGCAGTGGCACTGGCTGGTTTG GCCACCGTGGCCCAGGCCGACGTGCAATTGGTGGAGTCTGGGGGT GGTCTGGTTCAGCCTGGTGGTAGCCTGCGTCTGAGCTGTGCAGCAA GCGGTAGCATTGGTGGTCTGAATGCAATGGCATGGTATCGTCAGGC ACCGGGTAAAGAACGTGAACTGGTTGCAGGTATTTTTGGTGTTGGT AGCACCCGTTATGCAGATAGCGTTAAAGGTCGTTTTACCATTAGCC GTGACAATAGCAAAAACACCGTTTATCTGCAGATGAATAGCCTGC GTCCTGAAGATACCGCAGTTTATTATTGTCGCATGAGCAGCGTTAC CCGTGGTAGCAGCGATTATTGGGGTCAGGGGACCCTGGTCACCGTC TCCTCAGCGGCCGCAGAACAAAAACTCATCTCAGAAGAGGATCTG AATGGGGCCGCACATCATCATCATCATCAT |
| HER3 MS001 23 | 390 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTAGCATTTTTCGTATTAATGCAATGGCATGGTATCGTCAGGC ACCGGGTAAACAGCGTGAACTGGTTGCAGAAATTACCGCAGGCGG TAGCACCAATTATGCAGATAGCGTTAAAGGTCGCTTTACCATTAGC CGTGATAATAGCTGGAATACCCTGTATCTGCAGATGAATAGCCTGC GTCCTGAAGATACCGCAGTTTATTATTGCAACCTGGATCATTATAC CACCTGGGATCGTCGTAGCGCATATTGGGGTCAGGGGACCCTGGTC ACCGTCTCCTCAGCGGCCGCAGAACAAAAACTCATCTCAGAAGAG GATCTGAATGGGGCCGCACATCATCATCATCATCAT |
| HER3 MS001 | 391 | ATGAAAAAGACCGCTATCGCGATTGCAGTGGCACTGGCTGGTTTG GCCACCGTGGCCCAGGCCGAGGTGCAATTGGTGGAGTCTGGGGGT |

Figure 1 (Continued):

| | | |
|---|---|---|
| 24 | | GGTCTGGTTCAGCCTGGTGGTAGCCTGCGTCTGAGCTGTGCAGCAA GCGGTAGCATTTTTCGTATTAATGCAATGGCATGGTATCGTCAGGC ACCGGGTAAACAGCGTGAACTGGTTGCAGAAATTACCGCAGGCGG TAGCACCAATTATGCAGATAGCGTTAAAGGTCGCTTTACCATTAGC CGTGATAATAGCTGGAATACCCTGTATCTGCAGATGAATAGCCTGC GTGCAGAAGATACCGCAGTTTATTATTGCAACCTGGATCATTATAC CACCTGGGATCGTCGTAGCGCATATTGGGGTCAGGGGACCCTGGTC ACCGTCTCCTCAGCGGCCGCAGAACAAAAACTCATCTCAGAAGAG GATCTGAATGGGGCCGCACATCATCATCATCAT |
| HER3 MS001 25 | 392 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGCACCCTGTTTAAAATTAATGCAATGGGTTGGTATCGCCAGGC ACCGGGTAAACAGCGTGAACTGGTTGCACTGATTACCAGCAGCGA TACCACCGATTATGCAGAAGATGTTAAAGGTCGCTTTACCATTAGC CGTGATAATAGCTGGAATACCGTTATCTGCAGATGAATAGCCTGC GTCCTGAAGATACCGCAGTTTATTATTGTCACAGCGATCATTATAG CCTGGGTGTGCCGGAAAAACGTGTTATTCTGTATGGTCAGGGGACC CTGGTCACCGTCTCCTCAGCGGCCGCAGAACAAAAACTCATCTCAG AAGAGGATCTGAATGGGGCCGCACATCATCATCATCAT |
| HER3 MS001 27 | 393 | ATGAAAAAGACCGCTATCGCGATTGCAGTGGCACTGGCTGGTTTG GCCACCGTGGCCCAGGCCGACGTGCAATTGGTGGAGTCTGGGGGT GGTCTGGTTCAGCCTGGTGGTAGCCTGCGTCTGAGCTGTGCAGCAA GCGGTAGCATTTTTCGTATTAATGCAATGGCATGGTATCGTCAGGC ACCGGGTAAACAGCGTGAACTGGTTGCAGAAATTACCGCAGGCGG TAGCACCAATTATGCAGATAGCGTTAAAGGTCGCTTTACCATTAGC CGTGATAATAGCTGGAATACCCTGTATCTGCAGATGAATAGCCTGC GTCCTGAAGATACCGCAGTTTATTATTGCAACCTGGATCATTATAC CACCTGGGATCGTCGTAGCGCATATTGGGGTCAGGGGACCCTGGTC ACCGTCTCCTCAGCGGCCGCAGAACAAAAACTCATCTCAGAAGAG GATCTGAATGGGGCCGCACATCATCATCATCAT |
| HER3 MS001 28 | 394 | ATGAAAAAGACCGCTATCGCGATTGCAGTGGCACTGGCTGGTTTG GCCACCGTGGCCCAGGCCGACGTGCAATTGGTGGAGTCTGGGGGT GGTCTGGTTCAGCCTGGTGGTAGCCTGCGTCTGAGCTGTGCAGCAA GCGGTAGCATTTTTCGTATTAATGCAATGGCATGGTATCGTCAGGC ACCGGGTAAACAGCGTGAACTGGTTGCAGAAATTACCGCAGGCGG TAGCACCAATTATGCAGATAGCGTTAAAGGTCGCTTTACCATTAGC CGTGATAATAGCTGGAATACCCTGTATCTGCAGATGAATAGCCTGC GTGCAGAAGATACCGCAGTTTATTATTGCAACCTGGATCATTATAC CACCTGGGATCGTCGTAGCGCATATTGGGGTCAGGGGACCCTGGTC ACCGTCTCCTCAGCGGCCGCAGAACAAAAACTCATCTCAGAAGAG GATCTGAATGGGGCCGCACATCATCATCATCAT |
| HER3 MS001 29 | 395 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTTTTACCTTTAGCAGCTATCCGATGAGCTGGGTTCGTCAGGC |

Figure 1 (Continued):

| | | |
|---|---|---|
| | | ACCGGGTAAAGGTCCTGAATGGGTTAGCACCGTTAGTCCGGGTGG AATTACCACCAGTTATGCAGATAGCGTTAAAGGTCGTTTTACCATT AGCCGTGATAATAGCAAAAATACCCTGTATCTGCAGATGAATAGC CTGCGTCCTGAAGATACCGCAGTTTATTATTGTCTGCGTGATCTGG GTAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |
| HER3 MS001 30 | 396 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTTTTACCTTTAGCAGCTATCCGATGAGCTGGGTTCGTCAGGC ACCGGGTAAAGGTCCGGCATGGGTTAGCACCGTTAGTCCGGGTGG TATTACAACCAGTTATGCAGATAGCGTTAAAGGTCGTTTTACCATT AGCCGTGATAATAGCAAAAATACCCTGTATCTGCAGATGAATAGC CTGCGTCCTGAAGATACCGCAGTTTATTATTGTCTGCGTGATCTGG GTAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |
| HER3 MS001 31 | 397 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGTTTTACCTTTAGCAGCTATCCGATGAGCTGGGTTCGTCAGGC ACCGGGTAAAGGTCCTGAATGGGTTAGCACCGTTAGTCCGGGTGG AATTACCACCAGTTATGCAGATAGCGTTAAAGGTCGTTTTACCATT AGCCGTGATAATAGCAAAAATACCCTGTATCTGCAGATGAATAGC CTGCGTCCTGAAGATACCGCAGTTTATTATTGTCTGCGTGATCTGA GCAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |
| HER3 MS001 32 | 398 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTTCTCTGCGTCTGAGCTGTGCAGCAA GCGGTTTTACCTTTAGCAGCTATCCGATGAGCTGGGTTCGTCAGGC ACCGGGTAAAGGTCCGGCATGGGTTAGCACCGTTAGTCCGGGTGG AATTACCACCAGTTATGCAGATAGCGTTAAAGGTCGTTTTACCATT AGCCGTGATAATAGCAAAAATACCCTGTATCTGCAGATGAATAGC CTGCGTCCTGAAGATACCGCAGTTTATTATTGTCTGCGTGATCTGA GCAATCGTGGTCAGGGGACCCTGGTCACCGTCTCCTCAGCGGCCGC AGAACAAAAACTCATCTCAGAAGAGGATCTGAATGGGGCCGCACA TCATCATCATCATCAT |
| HER3 MS001 35 | 399 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC |

Figure 1 (Continued):

| | | |
|---|---|---|
| | | TGGGGGTGGTCTGGTTCAGCCTGGTGGTAGCCTGCGTCTGAGCTGT |
| | | GCAGCAAGCGGTAGCATTGGTGGTCTGAATGCAATGGCATGGTAT |
| | | CGTCAGGCACCGGGTAAAGAACGTGAACTGGTTGCAGGTATTTTG |
| | | GTGTTGGTAGCACCCGTTATGCAGATAGCGTTAAAGGTCGTTTTAC |
| | | CATTAGCCGTGACAATAGCAAAAACACCGTTTATCTGCAGATGAAT |
| | | AGCCTGCGTCCTGAAGATACCGCAGTTTATTATTGTCGCATGAGCA |
| | | GCGTTACCCGTGGTAGCAGCGATTATTGGGGTCAGGGGACCCTGGT |
| | | CACGGTCTCCTCAGGAGGTGGCGGATCCGGCGGAGGTAGTGAGGT |
| | | GCAGCTGGTGGAGTCTGGGGGTGGCTTGGTGCAACCGGGTAACAG |
| | | TCTGCGCCTTAGCTGCGCAGCGTCTGGCTTTACCTTCAGCTCCTTTG |
| | | GCATGAGCTGGGTTCGCCAGGCTCCGGGAAAAGGACTGGAATGGG |
| | | TTTCGTCTATTAGCGGCAGTGGTAGCGATACGCTCTACGCGGACTC |
| | | CGTGAAGGGCCGTTTCACCATCTCCCGCGATAACGCCAAAACTACA |
| | | CTGTATCTGCAAATGAATAGCCTGCGTCCTGAAGACACGGCCGTTT |
| | | ATTACTGTACTATTGGTGGCTCGTTAAGCCGTTCTTCACAGGGGAC |
| | | CCTGGTCACGGTCTCCTCAGGAGGTGGCGGGTCCGGAGGAGGTAG |
| | | TGAGGTGCAGCTGGTGGAGTCTGGGGGTGGTCTGGTTCAGCCTGGT |
| | | GGTAGCCTGCGTCTGAGCTGTGCAGCAAGCGGTCGTACCTATTATC |
| | | TGAATGCAATGGGTTGGTTTCGTCAGGCACCGGGTAAAGAACGTG |
| | | AATTTGTTGCAGCCATTGATTGGAGCGAAGGCAATAAAGATTATGC |
| | | CGATAGCGTGAAAGGTCGTTTTACCATTAGCCGTGATAACAGCAA |
| | | AAACACCGTTTATCTGCAGATGAATAGCCTGCGTCCTGAAGATACC |
| | | GCAGTTTATTATTGTGCAGCAGATACCCCTCCGTGGGGTCCGCTGA |
| | | TTTATATTGAAAGCTATGATAGCTGGGGTCAGGGGACCCTGGTCAC |
| | | CGTCTCCTCA |
| HER3 MS001 36 | 400 | ATGAGATTTCCTTCAATTTTTACTGCTGTTTTATTCGCAGCATCCTC |
| | | CGCATTAGCTGCTCCAGTCAACACTACAACAGAAGATGAAACGGC |
| | | ACAAATTCCGGCTGAAGCTGTCATCGGTTACTCAGATTTAGAAGGG |
| | | GATTTCGATGTTGCTGTTTTGCCATTTTCCAACAGCACAAATAACG |
| | | GGTTATTGTTTATAAATACTACTATTGCCAGCATTGCTGCTAAAGA |
| | | AGAAGGGGTATCTCTCGAAAAGAGAGACGTGCAATTGGTGGAGTC |
| | | TGGGGGTGGTCTGGTTCAGCCTGGTGGTAGCCTGCGTCTGAGCTGT |
| | | GCAGCAAGCGGTAGCATTGGTGGTCTGAATGCAATGGCATGGTAT |
| | | CGTCAGGCACCGGGTAAAGAACGTGAACTGGTTGCAGGTATTTTG |
| | | GTGTTGGTAGCACCCGTTATGCAGATAGCGTTAAAGGTCGTTTTAC |
| | | CATTAGCCGTGACAATAGCAAAAACACCGTTTATCTGCAGATGAAT |
| | | AGCCTGCGTCCTGAAGATACCGCAGTTTATTATTGTCGCATGAGCA |
| | | GCGTTACCCGTGGTAGCAGCGATTATTGGGGTCAGGGGACCCTGGT |
| | | CACGGTCTCCTCCGGAGGCGGTGGGTCAGGTGGCGGAGGCAGCGG |
| | | TGGAGGAGGTAGTGGCGGTGGCGGTAGTGGGGGTGGAGGCAGCG |
| | | GAGGCGGAGGCAGTGGGGCGGTGGATCCGAGGTGCAGTTGGTGG |
| | | AGTCTGGGGGTGGCTTGGTGCAACCGGGTAACAGTCTGCGCCTTAG |
| | | CTGCGCAGCGTCTGGCTTTACCTTCAGCTCCTTTGGCATGAGCTGG |
| | | GTTCGCCAGGCTCCGGGAAAAGGACTGGAATGGGTTTCGTCTATTA |
| | | GCGGCAGTGGTAGCGATACGCTCTACGCGGACTCCGTGAAGGGCC |
| | | GTTTCACCATCTCCCGCGATAACGCCAAAACTACACTGTATCTGCA |

Figure 1 (Continued):

| | | |
|---|---|---|
| | | AATGAATAGCCTGCGTCCTGAAGACACGGCCGTTTATTACTGTACT ATTGGTGGCTCGTTAAGCCGTTCTTCACAGGGGACCCTGGTCACGG TCTCGAGCGGAGGCGGTGGGTCAGGTGGCGGAGGCAGCGGTGGAG GAGGTAGTGGCGGTGGCGGTAGTGGGGGTGGAGGCAGCGGAGGC GGAGGCAGTGGGGGCGGTGGCTCAGAGGTACAACTAGTGGAGTCT GGGGGTGGTCTGGTTCAGCCTGGTGGTAGCCTGCGTCTGAGCTGTG CAGCAAGCGGTCGTACCTATTATCTGAATGCAATGGGTTGGTTTCG TCAGGCACCGGGTAAAGAACGTGAATTTGTTGCAGCCATTGATTGG AGCGAAGGCAATAAAGATTATGCCGATAGCGTGAAAGGTCGTTTT ACCATTAGCCGTGATAACAGCAAAAACACCGTTTATCTGCAGATG AATAGCCTGCGTCCTGAAGATACCGCAGTTTATTATTGTGCAGCAG ATACCCCTCCGTGGGGTCCGCTGATTTATATTGAAAGCTATGATAG CTGGGGTCAGGGGACCCTGGTCACCGTCTCCTCA |
| HER3 MS001 37 | 401 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC TGGGGGTGGTCTGGTTCAGCCTGGTGGTAGCCTGCGTCTGAGCTGT GCAGCAAGCGGTAGCATTGGTGGTCTGAATGCAATGGCATGGTAT CGTCAGGCACCGGGTAAAGAACGTGAACTGGTTGCAGGTATTTTTG GTGTTGGTAGCACCCGTTATGCAGATAGCGTTAAAGGTCGTTTTAC CATTAGCCGTGACAATAGCAAAAACACCGTTTATCTGCAGATGAAT AGCCTGCGTCCTGAAGATACCGCAGTTTATTATTGTCGCATGAGCA GCGTTACCCGTGGTAGCAGCGATTATTGGGGTCAGGGGACCCTGGT CACGGTCTCCTCAGGAGGTGGCGGATCCGGCGGAGGTAGTGAGGT GCAGCTGGTGGAGTCTGGGGGTGGTCTGGTTCAGCCTGGTGGTAGC CTGCGTCTGAGCTGTGCAGCAAGCGGTCGTACCTATTATCTGAATG CAATGGGTTGGTTTCGTCAGGCACCGGGTAAAGAACGTGAATTTGT TGCAGCCATTGATTGGAGCGAAGGCAATAAAGATTATGCCGATAG CGTGAAAGGTCGTTTTACCATTAGCCGTGATAACAGCAAAAACAC CGTTTATCTGCAGATGAATAGCCTGCGTCCTGAAGATACCGCAGTT TATTATTGTGCAGCAGATACCCCTCCGTGGGGTCCGCTGATTTATA TTGAAAGCTATGATAGCTGGGGTCAGGGGACCCTGGTCACGGTCTC CTCAGGAGGTGGCGGGTCCGGAGGAGGTAGTGAGGTGCAGCTGGT GGAGTCTGGGGGTGGCTTGGTGCAACCGGGTAACAGTCTGCGCCTT AGCTGCGCAGCGTCTGGCTTTACCTTCAGCTCCTTTGGCATGAGCT GGGTTCGCCAGGCTCCGGGAAAAGGACTGGAATGGGTTTCGTCTA TTAGCGGCAGTGGTAGCGATACGCTCTACGCGGACTCCGTGAAGG GCCGTTTCACCATCTCCCGCGATAACGCCAAAACTACACTGTATCT GCAAATGAATAGCCTGCGTCCTGAAGACACGGCCGTTTATTACTGT ACTATTGGTGGCTCGTTAAGCCGTTCTTCACAGGGGACCCTGGTCA CCGTCTCCTCA |
| HER3 MS001 | 402 | ATGAGATTTCCTTCAATTTTTACTGCTGTTTTATTCGCAGCATCCTC CGCATTAGCTGCTCCAGTCAACACTACAACAGAAGATGAAACGGC |

Figure 1 (Continued):

| 38 | | ACAAATTCCGGCTGAAGCTGTCATCGGTTACTCAGATTTAGAAGGG
GATTTCGATGTTGCTGTTTTGCCATTTTCCAACAGCACAAATAACG
GGTTATTGTTTATAAATACTACTATTGCCAGCATTGCTGCTAAAGA
AGAAGGGGTATCTCTCGAAAAGAGAGACGTGCAATTGGTGGAGTC
TGGGGGTGGTCTGGTTCAGCCTGGTGGTAGCCTGCGTCTGAGCTGT
GCAGCAAGCGGTAGCATTGGTGGTCTGAATGCAATGGCATGGTAT
CGTCAGGCACCGGGTAAAGAACGTGAACTGGTTGCAGGTATTTTTG
GTGTTGGTAGCACCCGTTATGCAGATAGCGTTAAAGGTCGTTTTAC
CATTAGCCGTGACAATAGCAAAAACACCGTTTATCTGCAGATGAAT
AGCCTGCGTCCTGAAGATACCGCAGTTTATTATTGTCGCATGAGCA
GCGTTACCCGTGGTAGCAGCGATTATTGGGGTCAGGGGACCCTGGT
CACGGTCTCCTCCGGAGGCGGTGGGTCAGGTGGCGGAGGCAGCGG
TGGAGGAGGTAGTGGCGGTGGCGGTAGTGGGGGTGGAGGCAGCG
GAGGCGGAGGCAGTGGGGGCGGTGGATCCGAGGTGCAGTTGGTGG
AGTCTGGGGGTGGTCTGGTTCAGCCTGGTGGTAGCCTGCGTCTGAG
CTGTGCAGCAAGCGGTCGTACCTATTATCTGAATGCAATGGGTTGG
TTTCGTCAGGCACCGGGTAAAGAACGTGAATTTGTTGCAGCCATTG
ATTGGAGCGAAGGCAATAAAGATTATGCCGATAGCGTGAAAGGTC
GTTTTACCATTAGCCGTGATAACAGCAAAAACACCGTTTATCTGCA
GATGAATAGCCTGCGTCCTGAAGATACCGCAGTTTATTATTGTGCA
GCAGATACCCCTCCGTGGGTCCGCTGATTTATATTGAAAGCTATG
ATAGCTGGGGTCAGGGGACCCTGGTCACGGTCTCGAGCGGAGGCG
GTGGGTCAGGTGGCGGAGGCAGCGGTGGAGGAGGTAGTGGCGGTG
GCGGTAGTGGGGGTGGAGGCAGCGGAGGCGGAGGCAGTGGGGGC
GGTGGCTCAGAGGTACAACTAGTGGAGTCTGGGGGTGGCTTGGTG
CAACCGGGTAACAGTCTGCGCCTTAGCTGCGCAGCGTCTGGCTTTA
CCTTCAGCTCCTTTGGCATGAGCTGGGTTCGCCAGGCTCCGGGAAA
AGGACTGGAATGGGTTTCGTCTATTAGCGGCAGTGGTAGCGATAC
GCTCTACGCGGACTCCGTGAAGGGCCGTTTCACCATCTCCCGCGAT
AACGCCAAAACTACACTGTATCTGCAAATGAATAGCCTGCGTCCTG
AAGACACGGCCGTTTATTACTGTACTATTGGTGGCTCGTTAAGCCG
TTCTTCACAGGGGACCCTGGTCACCGTCTCCTCA |
| HER3
MS001
39 | 403 | ATGAGATTTCCTTCAATTTTTACTGCTGTTTTATTCGCAGCATCCTC
CGCATTAGCTGCTCCAGTCAACACTACAACAGAAGATGAAACGGC
ACAAATTCCGGCTGAAGCTGTCATCGGTTACTCAGATTTAGAAGGG
GATTTCGATGTTGCTGTTTTGCCATTTTCCAACAGCACAAATAACG
GGTTATTGTTTATAAATACTACTATTGCCAGCATTGCTGCTAAAGA
AGAAGGGGTATCTCTCGAAAAGAGAGACGTGCAATTGGTGGAGTC
TGGGGGTGGTCTGGTTCAGCCTGGTGGTAGCCTGCGTCTGAGCTGT
GCAGCAAGCGGTAGCATTGGTGGTCTGAATGCAATGGCATGGTAT
CGTCAGGCACCGGGTAAAGAACGTGAACTGGTTGCAGGTATTTTTG
GTGTTGGTAGCACCCGTTATGCAGATAGCGTTAAAGGTCGTTTTAC
CATTAGCCGTGACAATAGCAAAAACACCGTTTATCTGCAGATGAAT
AGCCTGCGTCCTGAAGATACCGCAGTTTATTATTGTCGCATGAGCA
GCGTTACCCGTGGTAGCAGCGATTATTGGGGTCAGGGGACCCTGGT
CACGGTCTCCTCAGGAGGTGGCGGATCCGGCGGAGGTAGTGAGGT |

Figure 1 (Continued):

| | | |
|---|---|---|
| | | GCAGCTGGTGGAGTCTGGGGGTGGCTTGGTGCAACCGGGTAACAG<br>TCTGCGCCTTAGCTGCGCAGCGTCTGGCTTTACCTTCAGCTCCTTTG<br>GCATGAGCTGGGTTCGCCAGGCTCCGGGAAAAGGACTGGAATGGG<br>TTTCGTCTATTAGCGGCAGTGGTAGCGATACGCTCTACGCGGACTC<br>CGTGAAGGGCCGTTTCACCATCTCCCGCGATAACGCCAAAACTACA<br>CTGTATCTGCAAATGAATAGCCTGCGTCCTGAAGACACGGCCGTTT<br>ATTACTGTACTATTGGTGGCTCGTTAAGCCGTTCTTCACAGGGGAC<br>CCTGGTCACGGTCTCCTCAGGAGGTGGCGGGTCCGGAGGAGGTAG<br>TGAGGTGCAGCTGGTGGAGTCTGGGGGTGGTCTGGTTCAGCCTGGT<br>GGTAGCCTGCGTCTGAGCTGTGCAGCAAGCGGTAGCATTTTTCGTA<br>TTAATGCAATGGCATGGTATCGTCAGGCACCGGGTAAACAGCGTG<br>AACTGGTTGCAGAAATTACCGCAGGCGGTAGCACCAATTATGCAG<br>ATAGCGTTAAAGGTCGCTTTACCATTAGCCGTGATAATAGCTGGAA<br>TACCCTGTATCTGCAGATGAATAGCCTGCGTCCTGAAGATACCGCA<br>GTTTATTATTGCAACCTGGATCATTATACCACCTGGGATCGTCGTA<br>GCGCATATTGGGGTCAGGGGACCCTGGTCACCGTCTCCTCA |
| HER3<br>MS001<br>40 | 404 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGACGTGCAATTGGTGGAGTC<br>TGGGGGTGGTCTGGTTCAGCCTGGTGGTAGCCTGCGTCTGAGCTGT<br>GCAGCAAGCGGTAGCATTGGTGGTCTGAATGCAATGGCATGGTAT<br>CGTCAGGCACCGGGTAAGAACGTGAACTGGTTGCAGGTATTTTTG<br>GTGTTGGTAGCACCCGTTATGCAGATAGCGTTAAAGGTCGTTTTAC<br>CATTAGCCGTGACAATAGCAAAAACACCGTTTATCTGCAGATGAAT<br>AGCCTGCGTCCTGAAGATACCGCAGTTTATTATTGTCGCATGAGCA<br>GCGTTACCCGTGGTAGCAGCGATTATTGGGGTCAGGGGACCCTGGT<br>CACGGTCTCCTCCGGAGGCGGTGGGTCAGGTGGCGGAGGCAGCGG<br>TGGAGGAGGTAGTGGCGGTGGCGGTAGTGGGGGTGGAGGCAGCG<br>GAGGCGGAGGCAGTGGGGGCGGTGGATCCGAGGTGCAGTTGGTGG<br>AGTCTGGGGGTGGCTTGGTGCAACCGGGTAACAGTCTGCGCCTTAG<br>CTGCGCAGCGTCTGGCTTTACCTTCAGCTCCTTTGGCATGAGCTGG<br>GTTCGCCAGGCTCCGGGAAAAGGACTGGAATGGGTTTCGTCTATTA<br>GCGGCAGTGGTAGCGATACGCTCTACGCGGACTCCGTGAAGGGCC<br>GTTTCACCATCTCCCGCGATAACGCCAAAACTACACTGTATCTGCA<br>AATGAATAGCCTGCGTCCTGAAGACACGGCCGTTTATTACTGTACT<br>ATTGGTGGCTCGTTAAGCCGTTCTTCACAGGGGACCCTGGTCACGG<br>TCTCGAGCGGAGGCGGTGGGTCAGGTGGCGGAGGCAGCGGTGGAG<br>GAGGTAGTGGCGGTGGCGGTAGTGGGGGTGGAGGCAGCGGAGGC<br>GGAGGCAGTGGGGGCGGTGGCTCAGAGGTACAACTAGTGGAGTCT<br>GGGGGTGGTCTGGTTCAGCCTGGTGGTAGCCTGCGTCTGAGCTGTG<br>CAGCAAGCGGTAGCATTTTTCGTATTAATGCAATGGCATGGTATCG<br>TCAGGCACCGGGTAAACAGCGTGAACTGGTTGCAGAAATTACCGC<br>AGGCGGTAGCACCAATTATGCAGATAGCGTTAAAGGTCGCTTTACC |

Figure 1 (Continued):

| | | |
|---|---|---|
| | | ATTAGCCGTGATAATAGCTGGAATACCCTGTATCTGCAGATGAATA GCCTGCGTCCTGAAGATACCGCAGTTTATTATTGCAACCTGGATCA TTATACCACCTGGGATCGTCGTAGCGCATATTGGGGTCAGGGGACC CTGGTCACCGTCTCCTCA |
| HER3 MS001 41 | 405 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC TGGGGGTGGTCTGGTTCAGCCTGGTGGTAGCCTGCGTCTGAGCTGT GCAGCAAGCGGTAGCATTGGTGGTCTGAATGCAATGGCATGGTAT CGTCAGGCACCGGGTAAAGAACGTGAACTGGTTGCAGGTATTTTTG GTGTTGGTAGCACCCGTTATGCAGATAGCGTTAAAGGTCGTTTTAC CATTAGCCGTGACAATAGCAAAAACACCGTTTATCTGCAGATGAAT AGCCTGCGTCCTGAAGATACCGCAGTTTATTATTGTCGCATGAGCA GCGTTACCCGTGGTAGCAGCGATTATTGGGGTCAGGGGACCCTGGT CACGGTCTCCTCAGGAGGTGGCGGATCCGGCGGAGGTAGTGAGGT GCAGCTGGTGGAGTCTGGGGGTGGTCTGGTTCAGCCTGGTGGTAGC CTGCGTCTGAGCTGTGCAGCAAGCGGTAGCATTTTTCGTATTAATG CAATGGCATGGTATCGTCAGGCACCGGGTAAACAGCGTGAACTGG TTGCAGAAATTACCGCAGGCGGTAGCACCAATTATGCAGATAGCG TTAAAGGTCGCTTTACCATTAGCCGTGATAATAGCTGGAATACCCT GTATCTGCAGATGAATAGCCTGCGTCCTGAAGATACCGCAGTTTAT TATTGCAACCTGGATCATTATACCACCTGGGATCGTCGTAGCGCAT ATTGGGGTCAGGGGACCCTGGTCACGGTCTCCTCAGGAGGTGGCG GGTCCGGAGGAGGTAGTGAGGTGCAGCTGGTGGAGTCTGGGGGTG GCTTGGTGCAACCGGGTAACAGTCTGCGCCTTAGCTGCGCAGCGTC TGGCTTTACCTTCAGCTCCTTTGGCATGAGCTGGGTTCGCCAGGCT CCGGGAAAAGGACTGGAATGGGTTTCGTCTATTAGCGGCAGTGGT AGCGATACGCTCTACGCGGACTCCGTGAAGGGCCGTTTCACCATCT CCCGCGATAACGCCAAAACTACACTGTATCTGCAAATGAATAGCCT GCGTCCTGAAGACACGGCCGTTTATTACTGTACTATTGGTGGCTCG TTAAGCCGTTCTTCACAGGGGACCCTGGTCACCGTCTCCTCA |
| HER3 MS001 42 | 406 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC TGGGGGTGGTCTGGTTCAGCCTGGTGGTAGCCTGCGTCTGAGCTGT GCAGCAAGCGGTAGCATTGGTGGTCTGAATGCAATGGCATGGTAT CGTCAGGCACCGGGTAAAGAACGTGAACTGGTTGCAGGTATTTTTG GTGTTGGTAGCACCCGTTATGCAGATAGCGTTAAAGGTCGTTTTAC CATTAGCCGTGACAATAGCAAAAACACCGTTTATCTGCAGATGAAT AGCCTGCGTCCTGAAGATACCGCAGTTTATTATTGTCGCATGAGCA |

Figure 1 (Continued):

| | | |
|---|---|---|
| | | GCGTTACCCGTGGTAGCAGCGATTATTGGGGTCAGGGGACCCTGGT<br>CACGGTCTCCTCCGGAGGCGGTGGGTCAGGTGGCGGAGGCAGCGG<br>TGGAGGAGGTAGTGGCGGTGGCGGTAGTGGGGGTGGAGGCAGCG<br>GAGGCGGAGGCAGTGGGGGCGGTGGATCCGAGGTGCAGTTGGTGG<br>AGTCTGGGGGTGGTCTGGTTCAGCCTGGTGGTAGCCTGCGTCTGAG<br>CTGTGCAGCAAGCGGTAGCATTTTTCGTATTAATGCAATGGCATGG<br>TATCGTCAGGCACCGGGTAAACAGCGTGAACTGGTTGCAGAAATT<br>ACCGCAGGCGGTAGCACCAATTATGCAGATAGCGTTAAAGGTCGC<br>TTTACCATTAGCCGTGATAATAGCTGGAATACCCTGTATCTGCAGA<br>TGAATAGCCTGCGTCCTGAAGATACCGCAGTTTATTATTGCAACCT<br>GGATCATTATACCACCTGGGATCGTCGTAGCGCATATTGGGGTCAG<br>GGGACCCTGGTCACGGTCTCGAGCGGAGGCGGTGGGTCAGGTGGC<br>GGAGGCAGCGGTGGAGGAGGTAGTGGCGGTGGCGGTAGTGGGGG<br>TGGAGGCAGCGGAGGCGGAGGCAGTGGGGGCGGTGGCTCAGAGG<br>TACAACTAGTGGAGTCTGGGGGTGGCTTGGTGCAACCGGGTAACA<br>GTCTGCGCCTTAGCTGCGCAGCGTCTGGCTTTACCTTCAGCTCCTTT<br>GGCATGAGCTGGGTTCGCCAGGCTCCGGGAAAAGGACTGGAATGG<br>GTTTCGTCTATTAGCGGCAGTGGTAGCGATACGCTCTACGCGGACT<br>CCGTGAAGGGCCGTTTCACCATCTCCCGCGATAACGCCAAAACTAC<br>ACTGTATCTGCAAATGAATAGCCTGCGTCCTGAAGACACGGCCGTT<br>TATTACTGTACTATTGGTGGCTCGTTAAGCCGTTCTTCACAGGGGA<br>CCCTGGTCACCGTCTCCTCA |
| HER3<br>MS001<br>43 | 407 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGACGTGCAATTGGTGGAGTC<br>TGGGGGTGGTCTGGTTCAGCCTGGTGGTAGCCTGCGTCTGAGCTGT<br>GCAGCAAGCGGTAGCATTGGTGGTCTGAATGCAATGGCATGGTAT<br>CGTCAGGCACCGGGTAAAGAACGTGAACTGGTTGCAGGTATTTTTG<br>GTGTTGGTAGCACCCGTTATGCAGATAGCGTTAAAGGTCGTTTTAC<br>CATTAGCCGTGACAATAGCAAAAACACCGTTTATCTGCAGATGAAT<br>AGCCTGCGTCCTGAAGATACCGCAGTTTATTATTGTCGCATGAGCA<br>GCGTTACCCGTGGTAGCAGCGATTATTGGGGTCAGGGGACCCTGGT<br>CACGGTCTCCTCAGGAGGTGGCGGATCCGGCGGAGGTAGTGAGGT<br>GCAGCTGGTGGAGTCTGGGGGTGGCTTGGTGCAACCGGGTAACAG<br>TCTGCGCCTTAGCTGCGCAGCGTCTGGCTTTACCTTCAGCTCCTTTG<br>GCATGAGCTGGGTTCGCCAGGCTCCGGGAAAAGGACTGGAATGGG<br>TTTCGTCTATTAGCGGCAGTGGTAGCGATACGCTCTACGCGGACTC<br>CGTGAAGGGCCGTTTCACCATCTCCCGCGATAACGCCAAAACTACA<br>CTGTATCTGCAAATGAATAGCCTGCGTCCTGAAGACACGGCCGTTT<br>ATTACTGTACTATTGGTGGCTCGTTAAGCCGTTCTTCACAGGGGAC<br>CCTGGTCACGGTCTCCTCAGGAGGTGGCGGGTCCGGAGGAGGTAG<br>TGAGGTGCAGCTGGTGGAGTCTGGGGGTGGTCTGGTTCAGCCTGGT<br>GGTAGCCTGCGTCTGAGCTGTGCAGCAAGCGGCACCCTGTTTAAAA |

Figure 1 (Continued):

| | | |
|---|---|---|
| | | TTAATGCAATGGGTTGGTATCGCCAGGCACCGGGTAAACGTCGTG AACTGGTTGCACTGATTACCAGCAGCGATACCACCGATTATGCAGA AGATGTTAAAGGTCGCTTTACCATTAGCCGTGATAATAGCTGGAAT ACCGTTTATCTGCAGATGAATAGCCTGCGTCCTGAAGATACCGCAG TTTATTATTGTCACAGCGATCATTATAGCCTGGGTGTGCCGGAAAA ACGTGTTATTCTGTATGGTCAGGGGACCCTGGTCACCGTCTCCTCA |
| HER3 MS001 44 | 408 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC TGGGGGTGGTCTGGTTCAGCCTGGTGGTAGCCTGCGTCTGAGCTGT GCAGCAAGCGGTAGCATTGGTGGTCTGAATGCAATGGCATGGTAT CGTCAGGCACCGGGTAAAGAACGTGAACTGGTTGCAGGTATTTTTG GTGTTGGTAGCACCCGTTATGCAGATAGCGTTAAAGGTCGTTTTAC CATTAGCCGTGACAATAGCAAAAACACCGTTTATCTGCAGATGAAT AGCCTGCGTCCTGAAGATACCGCAGTTTATTATTGTCGCATGAGCA GCGTTACCCGTGGTAGCAGCGATTATTGGGGTCAGGGGACCCTGGT CACGGTCTCCTCCGGAGGCGGTGGGTCAGGTGGCGGAGGCAGCGG TGGAGGAGGTAGTGGCGGTGGCGGTAGTGGGGGTGGAGGCAGCG GAGGCGGAGGCAGTGGGGGCGGTGGATCCGAGGTGCAGTTGGTGG AGTCTGGGGGTGGCTTGGTGCAACCGGGTAACAGTCTGCGCCTTAG CTGCGCAGCGTCTGGCTTTACCTTCAGCTCCTTTGGCATGAGCTGG GTTCGCCAGGCTCCGGGAAAAGGACTGGAATGGGTTTCGTCTATTA GCGGCAGTGGTAGCGATACGCTCTACGCGGACTCCGTGAAGGGCC GTTTCACCATCTCCCGCGATAACGCCAAAACTACACTGTATCTGCA AATGAATAGCCTGCGTCCTGAAGACACGGCCGTTTATTACTGTACT ATTGGTGGCTCGTTAAGCCGTTCTTCACAGGGGACCCTGGTCACGG TCTCGAGCGGAGGCGGTGGGTCAGGTGGCGGAGGCAGCGGTGGAG GAGGTAGTGGCGGTGGCGGTAGTGGGGGTGGAGGCAGCGGAGGC GGAGGCAGTGGGGGCGGTGGCTCAGAGGTACAACTAGTGGAGTCT GGGGGTGGTCTGGTTCAGCCTGGTGGTAGCCTGCGTCTGAGCTGTG CAGCAAGCGGCACCCTGTTTAAAATTAATGCAATGGGTTGGTATCG CCAGGCACCGGGTAAACGTCGTGAACTGGTTGCACTGATTACCAG CAGCGATACCACCGATTATGCAGAAGATGTTAAAGGTCGCTTTACC ATTAGCCGTGATAATAGCTGGAATACCGTTTATCTGCAGATGAATA GCCTGCGTCCTGAAGATACCGCAGTTTATTATTGTCACAGCGATCA TTATAGCCTGGGTGTGCCGGAAAAACGTGTTATTCTGTATGGTCAG GGGACCCTGGTCACCGTCTCCTCA |
| HER3 MS001 45 | 409 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC |

Figure 1 (Continued):

| | | |
|---|---|---|
| | | TGGGGGTGGTCTGGTTCAGCCTGGTGGTAGCCTGCGTCTGAGCTGT |
| | | GCAGCAAGCGGTAGCATTGGTGGTCTGAATGCAATGGCATGGTAT |
| | | CGTCAGGCACCGGGTAAAGAACGTGAACTGGTTGCAGGTATTTTTG |
| | | GTGTTGGTAGCACCCGTTATGCAGATAGCGTTAAAGGTCGTTTTAC |
| | | CATTAGCCGTGACAATAGCAAAAACACCGTTTATCTGCAGATGAAT |
| | | AGCCTGCGTCCTGAAGATACCGCAGTTTATTATTGTCGCATGAGCA |
| | | GCGTTACCCGTGGTAGCAGCGATTATTGGGGTCAGGGGACCCTGGT |
| | | CACGGTCTCCTCAGGAGGTGGCGGATCCGGCGGAGGTAGTGAGGT |
| | | GCAGCTGGTGGAGTCTGGGGGTGGTCTGGTTCAGCCTGGTGGTAGC |
| | | CTGCGTCTGAGCTGTGCAGCAAGCGGCACCCTGTTTAAAATTAATG |
| | | CAATGGGTTGGTATCGCCAGGCACCGGGTAAACGTCGTGAACTGG |
| | | TTGCACTGATTACCAGCAGCGATACCACCGATTATGCAGAAGATGT |
| | | TAAAGGTCGCTTTACCATTAGCCGTGATAATAGCTGGAATACCGTT |
| | | TATCTGCAGATGAATAGCCTGCGTCCTGAAGATACCGCAGTTTATT |
| | | ATTGTCACAGCGATCATTATAGCCTGGGTGTGCCGGAAAAACGTGT |
| | | TATTCTGTATGGTCAGGGGACCCTGGTCACGGTCTCCTCAGGAGGT |
| | | GGCGGGTCCGGAGGAGGTAGTGAGGTGCAGCTGGTGGAGTCTGGG |
| | | GGTGGCTTGGTGCAACCGGGTAACAGTCTGCGCCTTAGCTGCGCAG |
| | | CGTCTGGCTTTACCTTCAGCTCCTTTGGCATGAGCTGGGTTCGCCA |
| | | GGCTCCGGGAAAAGGACTGGAATGGGTTTCGTCTATTAGCGGCAG |
| | | TGGTAGCGATACGCTCTACGCGGACTCCGTGAAGGGCCGTTTCACC |
| | | ATCTCCCGCGATAACGCCAAAACTACACTGTATCTGCAAATGAATA |
| | | GCCTGCGTCCTGAAGACACGGCCGTTTATTACTGTACTATTGGTGG |
| | | CTCGTTAAGCCGTTCTTCACAGGGGACCCTGGTCACCGTCTCCTCA |
| HER3 MS001 46 | 410 | ATGAGATTTCCTTCAATTTTTACTGCTGTTTTATTCGCAGCATCCTC |
| | | CGCATTAGCTGCTCCAGTCAACACTACAACAGAAGATGAAACGGC |
| | | ACAAATTCCGGCTGAAGCTGTCATCGGTTACTCAGATTTAGAAGGG |
| | | GATTTCGATGTTGCTGTTTTGCCATTTTCCAACAGCACAAATAACG |
| | | GGTTATTGTTTATAAATACTACTATTGCCAGCATTGCTGCTAAAGA |
| | | AGAAGGGGTATCTCTCGAAAAGAGAGACGTGCAATTGGTGGAGTC |
| | | TGGGGGTGGTCTGGTTCAGCCTGGTGGTAGCCTGCGTCTGAGCTGT |
| | | GCAGCAAGCGGTAGCATTGGTGGTCTGAATGCAATGGCATGGTAT |
| | | CGTCAGGCACCGGGTAAAGAACGTGAACTGGTTGCAGGTATTTTTG |
| | | GTGTTGGTAGCACCCGTTATGCAGATAGCGTTAAAGGTCGTTTTAC |
| | | CATTAGCCGTGACAATAGCAAAAACACCGTTTATCTGCAGATGAAT |
| | | AGCCTGCGTCCTGAAGATACCGCAGTTTATTATTGTCGCATGAGCA |
| | | GCGTTACCCGTGGTAGCAGCGATTATTGGGGTCAGGGGACCCTGGT |
| | | CACGGTCTCCTCCGGAGGCGGTGGGTCAGGTGGCGGAGGCAGCGG |
| | | TGGAGGAGGTAGTGGCGGTGGCGGTAGTGGGGGTGGAGGCAGCG |
| | | GAGGCGGAGGCAGTGGGGGCGGTGGATCCGAGGTGCAGTTGGTGG |
| | | AGTCTGGGGGTGGTCTGGTTCAGCCTGGTGGTAGCCTGCGTCTGAG |
| | | CTGTGCAGCAAGCGGCACCCTGTTTAAAATTAATGCAATGGGTTGG |
| | | TATCGCCAGGCACCGGGTAAACGTCGTGAACTGGTTGCACTGATTA |
| | | CCAGCAGCGATACCACCGATTATGCAGAAGATGTTAAAGGTCGCT |
| | | TTACCATTAGCCGTGATAATAGCTGGAATACCGTTTATCTGCAGAT |
| | | GAATAGCCTGCGTCCTGAAGATACCGCAGTTTATTATTGTCACAGC |

Figure 1 (Continued):

| | | |
|---|---|---|
| | | GATCATTATAGCCTGGGTGTGCCGGAAAAACGTGTTATTCTGTATG GTCAGGGGACCCTGGTCACGGTCTCGAGCGGAGGCGGTGGGTCAG GTGGCGGAGGCAGCGGTGGAGGAGGTAGTGGCGGTGGCGGTAGTG GGGGTGGAGGCAGCGGAGGCGGAGGCAGTGGGGGCGGTGGCTCA GAGGTACAACTAGTGGAGTCTGGGGGTGGCTTGGTGCAACCGGGT AACAGTCTGCGCCTTAGCTGCGCAGCGTCTGGCTTTACCTTCAGCT CCTTTGGCATGAGCTGGGTTCGCCAGGCTCCGGGAAAAGGACTGG AATGGGTTTCGTCTATTAGCGGCAGTGGTAGCGATACGCTCTACGC GGACTCCGTGAAGGGCCGTTTCACCATCTCCCGCGATAACGCCAAA ACTACACTGTATCTGCAAATGAATAGCCTGCGTCCTGAAGACACGG CCGTTTATTACTGTACTATTGGTGGCTCGTTAAGCCGTTCTTCACAG GGGACCCTGGTCACCGTCTCCTCA |
| HER3 MS001 47 | 411 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAAGAGAGGTGCAATTGGTGGAGTC TGGGGGTGGTCTGGTTCAGCCTGGTGGTAGCCTGCGTCTGAGCTGT GCAGCAAGCGGTTTTACCTTTAGCAGCTATCCGATGAGCTGGGTTC GTCAGGCACCGGGTAAAGGTCCTGAATGGGTTAGCACCGTTAGTC CGGGTGGAATTACCACCAGTTATGCAGATAGCGTTAAAGGTCGTTT TACCATTAGCCGTGATAATAGCAAAAATACCCTGTATCTGCAGATG AATAGCCTGCGTCCTGAAGATACCGCAGTTTATTATTGTCTGCGTG ATCTGGGTAATCGTGGTCAGGGGACCCTGGTCACGGTCTCCTCCGG AGGCGGTGGGTCAGGTGGCGGAGGCAGCGGTGGAGGAGGTAGTG GCGGTGGCGGTAGTGGGGGTGGAGGCAGCGGAGGCGGAGGCAGT GGGGGCGGTGGATCCGAGGTGCAGTTGGTGGAGTCTGGGGGTGGC TTGGTGCAACCGGGTAACAGTCTGCGCCTTAGCTGCGCAGCGTCTG GCTTTACCTTCAGCTCCTTTGGCATGAGCTGGGTTCGCCAGGCTCC GGGAAAAGGACTGGAATGGGTTTCGTCTATTAGCGGCAGTGGTAG CGATACGCTCTACGCGGACTCCGTGAAGGGCCGTTTCACCATCTCC CGCGATAACGCCAAAACTACACTGTATCTGCAAATGAATAGCCTG CGTCCTGAAGACACGGCCGTTTATTACTGTACTATTGGTGGCTCGT TAAGCCGTTCTTCACAGGGGACCCTGGTCACGGTCTCGAGCGGAG GCGGTGGGTCAGGTGGCGGAGGCAGCGGTGGAGGAGGTAGTGGC GGTGGCGGTAGTGGGGGTGGAGGCAGCGGAGGCGGAGGCAGTGG GGGCGGTGGCTCAGAGGTACAACTAGTGGAGTCTGGGGGTGGTCT GGTTCAGCCTGGTGGTAGCCTGCGTCTGAGCTGTGCAGCAAGCGGT AGCATTTTTCGTATTAATGCAATGGCATGGTATCGTCAGGCACCGG GTAAACAGCGTGAACTGGTTGCAGAAATTACCGCAGGCGGTAGCA CCAATTATGCAGATAGCGTTAAAGGTCGCTTTACCATTAGCCGTGA TAATAGCTGGAATACCCTGTATCTGCAGATGAATAGCCTGCGTCCT GAAGATACCGCAGTTTATTATTGCAACCTGGATCATTATACCACCT GGGATCGTCGTAGCGCATATTGGGGTCAGGGGACCCTGGTCACCG TCTCCTCA |

Figure 1 (Continued):

| | | |
|---|---|---|
| HER3 MS001 48 | 412 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAAGAGAGGTGCAATTGGTGGAGTC TGGGGGTGGTCTGGTTCAGCCTGGTGGTAGCCTGCGTCTGAGCTGT GCAGCAAGCGGTTTTACCTTTAGCAGCTATCCGATGAGCTGGGTTC GTCAGGCACCGGGTAAAGGTCCGGCATGGGTTAGCACCGTTAGTC CGGGTGGTATTACAACCAGTTATGCAGATAGCGTTAAAGGTCGTTT TACCATTAGCCGTGATAATAGCAAAAATACCCTGTATCTGCAGATG AATAGCCTGCGTCCTGAAGATACCGCAGTTTATTATTGTCTGCGTG ATCTGGGTAATCGTGGTCAGGGGACCCTGGTCACGGTCTCCTCCGG AGGCGGTGGGTCAGGTGGCGGAGGCAGCGGTGGAGGAGGTAGTG GCGGTGGCGGTAGTGGGGGTGGAGGCAGCGGAGGCGGAGGCAGT GGGGGCGGTGGATCCGAGGTGCAGTTGGTGGAGTCTGGGGGTGGC TTGGTGCAACCGGGTAACAGTCTGCGCCTTAGCTGCGCAGCGTCTG GCTTTACCTTCAGCTCCTTTGGCATGAGCTGGGTTCGCCAGGCTCC GGGAAAAGGACTGGAATGGGTTTCGTCTATTAGCGGCAGTGGTAG CGATACGCTCTACGCGGACTCCGTGAAGGGCCGTTTCACCATCTCC CGCGATAACGCCAAAACTACACTGTATCTGCAAATGAATAGCCTG CGTCCTGAAGACACGGCCGTTTATTACTGTACTATTGGTGGCTCGT TAAGCCGTTCTTCACAGGGGACCCTGGTCACGGTCTCGAGCGGAG GCGGTGGGTCAGGTGGCGGAGGCAGCGGTGGAGGAGGTAGTGGC GGTGGCGGTAGTGGGGGTGGAGGCAGCGGAGGCGGAGGCAGTGG GGGCGGTGGCTCAGAGGTACAACTAGTGGAGTCTGGGGGTGGTCT GGTTCAGCCTGGTGGTAGCCTGCGTCTGAGCTGTGCAGCAAGCGGT AGCATTTTTCGTATTAATGCAATGGCATGGTATCGTCAGGCACCGG GTAAACAGCGTGAACTGGTTGCAGAAATTACCGCAGGCGGTAGCA CCAATTATGCAGATAGCGTTAAAGGTCGCTTTACCATTAGCCGTGA TAATAGCTGGAATACCCTGTATCTGCAGATGAATAGCCTGCGTCCT GAAGATACCGCAGTTTATTATTGCAACCTGGATCATTATACCACCT GGGATCGTCGTAGCGCATATTGGGGTCAGGGGACCCTGGTCACCG TCTCCTCA |
| HER3 MS001 49 | 413 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGGTGCAATTGGTGGAGTC TGGGGGTGGTCTGGTTCAGCCTGGTGGTAGCCTGCGTCTGAGCTGT GCAGCAAGCGGTTTTACCTTTAGCAGCTATCCGATGAGCTGGGTTC GTCAGGCACCGGGTAAAGGTCCTGAATGGGTTAGCACCGTTAGTC CGGGTGGAATTACCACCAGTTATGCAGATAGCGTTAAAGGTCGTTT TACCATTAGCCGTGATAATAGCAAAAATACCCTGTATCTGCAGATG AATAGCCTGCGTCCTGAAGATACCGCAGTTTATTATTGTCTGCGTG |

Figure 1 (Continued):

| | | |
|---|---|---|
| | | ATCTGGGTAATCGTGGTCAGGGGACCCTGGTCACGGTCTCCTCCGG AGGCGGTGGGTCAGGTGGCGGAGGCAGCGGTGGAGGAGGTAGTG GCGGTGGCGGTAGTGGGGGTGGAGGCAGCGGAGGCGGAGGCAGT GGGGGCGGTGGATCCGAGGTGCAGTTGGTGGAGTCTGGGGGTGGT CTGGTTCAGCCTGGTGGTAGCCTGCGTCTGAGCTGTGCAGCAAGCG GTAGCATTTTTCGTATTAATGCAATGGCATGGTATCGTCAGGCACC GGGTAAACAGCGTGAACTGGTTGCAGAAATTACCGCAGGCGGTAG CACCAATTATGCAGATAGCGTTAAAGGTCGCTTTACCATTAGCCGT GATAATAGCTGGAATACCCTGTATCTGCAGATGAATAGCCTGCGTC CTGAAGATACCGCAGTTTATTATTGCAACCTGGATCATTATACCAC CTGGGATCGTCGTAGCGCATATTGGGGTCAGGGGACCCTGGTCAC GGTCTCGAGCGGAGGCGGTGGGTCAGGTGGCGGAGGCAGCGGTGG AGGAGGTAGTGGCGGTGGCGGTAGTGGGGGTGGAGGCAGCGGAG GCGGAGGCAGTGGGGGCGGTGGCTCAGAGGTACAACTAGTGGAGT CTGGGGGTGGCTTGGTGCAACCGGGTAACAGTCTGCGCCTTAGCTG CGCAGCGTCTGGCTTTACCTTCAGCTCCTTTGGCATGAGCTGGGTT CGCCAGGCTCCGGGAAAAGGACTGGAATGGGTTTCGTCTATTAGC GGCAGTGGTAGCGATACGCTCTACGCGGACTCCGTGAAGGGCCGT TTCACCATCTCCCGCGATAACGCCAAAACTACACTGTATCTGCAAA TGAATAGCCTGCGTCCTGAAGACACGGCCGTTTATTACTGTACTAT TGGTGGCTCGTTAAGCCGTTCTTCACAGGGGACCCTGGTCACCGTC TCCTCA |
| HER3 MS001 50 | 414 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGTTTTACCTTTAGCAGCTATCCGATGAGCTGGGTTC GTCAGGCACCGGGTAAAGGTCCGGCATGGGTTAGCACCGTTAGTC CGGGTGGTATTACAACCAGTTATGCAGATAGCGTTAAAGGTCGTTT TACCATTAGCCGTGATAATAGCAAAAATACCCTGTATCTGCAGATG AATAGCCTGCGTCCTGAAGATACCGCAGTTTATTATTGTCTGCGTG ATCTGGGTAATCGTGGTCAGGGGACCCTGGTCACGGTCTCCTCCGG AGGCGGTGGGTCAGGTGGCGGAGGCAGCGGTGGAGGAGGTAGTG GCGGTGGCGGTAGTGGGGGTGGAGGCAGCGGAGGCGGAGGCAGT GGGGGCGGTGGATCCGAGGTGCAGTTGGTGGAGTCTGGGGGTGGT CTGGTTCAGCCTGGTGGTAGCCTGCGTCTGAGCTGTGCAGCAAGCG GTAGCATTTTTCGTATTAATGCAATGGCATGGTATCGTCAGGCACC GGGTAAACAGCGTGAACTGGTTGCAGAAATTACCGCAGGCGGTAG CACCAATTATGCAGATAGCGTTAAAGGTCGCTTTACCATTAGCCGT GATAATAGCTGGAATACCCTGTATCTGCAGATGAATAGCCTGCGTC CTGAAGATACCGCAGTTTATTATTGCAACCTGGATCATTATACCAC CTGGGATCGTCGTAGCGCATATTGGGGTCAGGGGACCCTGGTCAC GGTCTCGAGCGGAGGCGGTGGGTCAGGTGGCGGAGGCAGCGGTGG |

Figure 1 (Continued):

| | | |
|---|---|---|
| | | AGGAGGTAGTGGCGGTGGCGGTAGTGGGGGTGGAGGCAGCGGAG<br>GCGGAGGCAGTGGGGGCGGTGGCTCAGAGGTACAACTAGTGGAGT<br>CTGGGGGTGGCTTGGTGCAACCGGGTAACAGTCTGCGCCTTAGCTG<br>CGCAGCGTCTGGCTTTACCTTCAGCTCCTTTGGCATGAGCTGGGTT<br>CGCCAGGCTCCGGGAAAAGGACTGGAATGGGTTTCGTCTATTAGC<br>GGCAGTGGTAGCGATACGCTCTACGCGGACTCCGTGAAGGGCCGT<br>TTCACCATCTCCCGCGATAACGCCAAAACTACACTGTATCTGCAAA<br>TGAATAGCCTGCGTCCTGAAGACACGGCCGTTTATTACTGTACTAT<br>TGGTGGCTCGTTAAGCCGTTCTTCACAGGGGACCCTGGTCACCGTC<br>TCCTCA |
| HER3<br>MS001<br>51 | 415 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGACGTGCAATTGGTGGAGTC<br>TGGGGGTGGTCTGGTTCAGCCTGGTGGTAGCCTGCGTCTGAGCTGT<br>GCAGCAAGCGGTAGCATTTTTCGTATTAATGCAATGGCATGGTATC<br>GTCAGGCACCGGGTAAACAGCGTGAACTGGTTGCAGAAATTACCG<br>CAGGCGGTAGCACCAATTATGCAGATAGCGTTAAAGGTCGCTTTAC<br>CATTAGCCGTGATAATAGCTGGAATACCCTGTATCTGCAGATGAAT<br>AGCCTGCGTCCTGAAGATACCGCAGTTTATTATTGCAACCTGGATC<br>ATTATACCACCTGGGATCGTCGTAGCGCATATTGGGGTCAGGGGAC<br>CCTGGTCACGGTCTCCTCCGGAGGCGGTGGGTCAGGTGGCGGAGG<br>CAGCGGTGGAGGAGGTAGTGGCGGTGGCGGTAGTGGGGGTGGAG<br>GCAGCGGAGGCGGAGGCAGTGGGGGCGGTGGATCCGAGGTGCAG<br>TTGGTGGAGTCTGGGGGTGGCTTGGTGCAACCGGGTAACAGTCTGC<br>GCCTTAGCTGCGCAGCGTCTGGCTTTACCTTCAGCTCCTTTGGCATG<br>AGCTGGGTTCGCCAGGCTCCGGGAAAAGGACTGGAATGGGTTTCG<br>TCTATTAGCGGCAGTGGTAGCGATACGCTCTACGCGGACTCCGTGA<br>AGGGCCGTTTCACCATCTCCCGCGATAACGCCAAAACTACACTGTA<br>TCTGCAAATGAATAGCCTGCGTCCTGAAGACACGGCCGTTTATTAC<br>TGTACTATTGGTGGCTCGTTAAGCCGTTCTTCACAGGGGACCCTGG<br>TCACGGTCTCGAGCGGAGGCGGTGGGTCAGGTGGCGGAGGCAGCG<br>GTGGAGGAGGTAGTGGCGGTGGCGGTAGTGGGGGTGGAGGCAGC<br>GGAGGCGGAGGCAGTGGGGGCGGTGGCTCAGAGGTACAACTAGTG<br>GAGTCTGGGGGTGGTCTGGTTCAGCCTGGTGGTAGCCTGCGTCTGA<br>GCTGTGCAGCAAGCGGTTTACCTTTAGCAGCTATCCGATGAGCTG<br>GGTTCGTCAGGCACCGGGTAAAGGTCCTGAATGGGTTAGCACCGTT<br>AGTCCGGGTGGAATTACCACCAGTTATGCAGATAGCGTTAAAGGT<br>CGTTTTACCATTAGCCGTGATAATAGCAAAAATACCCTGTATCTGC<br>AGATGAATAGCCTGCGTCCTGAAGATACCGCAGTTTATTATTGTCT<br>GCGTGATCTGGGTAATCGTGGTCAGGGGACCCTGGTCACCGTCTCC<br>TCA |
| HER3<br>MS001 | 416 | ATGAGATTTCCTTCAATTTTTACTGCTGTTTTATTCGCAGCATCCTC<br>CGCATTAGCTGCTCCAGTCAACACTACAACAGAAGATGAAACGGC |

Figure 1 (Continued):

| | | |
|---|---|---|
| 52 | | ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGACGTGCAATTGGTGGAGTC<br>TGGGGGTGGTCTGGTTCAGCCTGGTGGTAGCCTGCGTCTGAGCTGT<br>GCAGCAAGCGGTAGCATTTTTCGTATTAATGCAATGGCATGGTATC<br>GTCAGGCACCGGGTAAACAGCGTGAACTGGTTGCAGAAATTACCG<br>CAGGCGGTAGCACCAATTATGCAGATAGCGTTAAAGGTCGCTTTAC<br>CATTAGCCGTGATAATAGCTGGAATACCCTGTATCTGCAGATGAAT<br>AGCCTGCGTCCTGAAGATACCGCAGTTTATTATTGCAACCTGGATC<br>ATTATACCACCTGGGATCGTCGTAGCGCATATTGGGGTCAGGGGAC<br>CCTGGTCACGGTCTCCTCCGGAGGCGGTGGGTCAGGTGGCGGAGG<br>CAGCGGTGGAGGAGGTAGTGGCGGTGGCGGTAGTGGGGGTGGAG<br>GCAGCGGAGGCGGAGGCAGTGGGGGCGGTGGATCCGAGGTGCAG<br>TTGGTGGAGTCTGGGGGTGGCTTGGTGCAACCGGGTAACAGTCTGC<br>GCCTTAGCTGCGCAGCGTCTGGCTTTACCTTCAGCTCCTTTGGCATG<br>AGCTGGGTTCGCCAGGCTCCGGGAAAAGGACTGGAATGGGTTTCG<br>TCTATTAGCGGCAGTGGTAGCGATACGCTCTACGCGGACTCCGTGA<br>AGGGCCGTTTCACCATCTCCCGCGATAACGCCAAAACTACACTGTA<br>TCTGCAAATGAATAGCCTGCGTCCTGAAGACACGGCCGTTTATTAC<br>TGTACTATTGGTGGCTCGTTAAGCCGTTCTTCACAGGGGACCCTGG<br>TCACGGTCTCGAGCGGAGGCGGTGGGTCAGGTGGCGGAGGCAGCG<br>GTGGAGGAGGTAGTGGCGGTGGCGGTAGTGGGGGTGGAGGCAGC<br>GGAGGCGGAGGCAGTGGGGGCGGTGGCTCAGAGGTACAACTAGTG<br>GAGTCTGGGGGTGGTCTGGTTCAGCCTGGTGGTAGCCTGCGTCTGA<br>GCTGTGCAGCAAGCGGTTTTACCTTTAGCAGCTATCCGATGAGCTG<br>GGTTCGTCAGGCACCGGGTAAAGGTCCGGCATGGGTTAGCACCGT<br>TAGTCCGGGTGGTATTACAACCAGTTATGCAGATAGCGTTAAAGGT<br>CGTTTTACCATTAGCCGTGATAATAGCAAAAATACCCTGTATCTGC<br>AGATGAATAGCCTGCGTCCTGAAGATACCGCAGTTTATTATTGTCT<br>GCGTGATCTGGGTAATCGTGGTCAGGGGACCCTGGTCACCGTCTCC<br>TCA |
| HER3<br>MS001<br>53 | 417 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGACGTGCAATTGGTGGAGTC<br>TGGGGGTGGTCTGGTTCAGCCTGGTGGTAGCCTGCGTCTGAGCTGT<br>GCAGCAAGCGGTAGCATTTTTCGTATTAATGCAATGGCATGGTATC<br>GTCAGGCACCGGGTAAACAGCGTGAACTGGTTGCAGAAATTACCG<br>CAGGCGGTAGCACCAATTATGCAGATAGCGTTAAAGGTCGCTTTAC<br>CATTAGCCGTGATAATAGCTGGAATACCCTGTATCTGCAGATGAAT<br>AGCCTGCGTCCTGAAGATACCGCAGTTTATTATTGCAACCTGGATC<br>ATTATACCACCTGGGATCGTCGTAGCGCATATTGGGGTCAGGGGAC<br>CCTGGTCACGGTCTCCTCCGGAGGCGGTGGGTCAGGTGGCGGAGG |

Figure 1 (Continued):

| | | |
|---|---|---|
| | | CAGCGGTGGAGGAGGTAGTGGCGGTGGCGGTAGTGGGGGTGGAG GCAGCGGAGGCGGAGGCAGTGGGGGCGGTGGATCCGAGGTGCAG TTGGTGGAGTCTGGGGGTGGTCTGGTTCAGCCTGGTGGTAGCCTGC GTCTGAGCTGTGCAGCAAGCGGTTTTACCTTTAGCAGCTATCCGAT GAGCTGGGTTCGTCAGGCACCGGGTAAAGGTCCTGAATGGGTTAG CACCGTTAGTCCGGGTGGAATTACCACCAGTTATGCAGATAGCGTT AAAGGTCGTTTTACCATTAGCCGTGATAATAGCAAAAATACCCTGT ATCTGCAGATGAATAGCCTGCGTCCTGAAGATACCGCAGTTTATTA TTGTCTGCGTGATCTGGGTAATCGTGGTCAGGGGACCCTGGTCACG GTCTCGAGCGGAGGCGGTGGGTCAGGTGGCGGAGGCAGCGGTGGA GGAGGTAGTGGCGGTGGCGGTAGTGGGGGTGGAGGCAGCGGAGG CGGAGGCAGTGGGGGCGGTGGCTCAGAGGTACAACTAGTGGAGTC TGGGGGTGGCTTGGTGCAACCGGGTAACAGTCTGCGCCTTAGCTGC GCAGCGTCTGGCTTTACCTTCAGCTCCTTTGGCATGAGCTGGGTTC GCCAGGCTCCGGGAAAAGGACTGGAATGGGTTTCGTCTATTAGCG GCAGTGGTAGCGATACGCTCTACGCGGACTCCGTGAAGGGCCGTTT CACCATCTCCCGCGATAACGCCAAAACTACACTGTATCTGCAAATG AATAGCCTGCGTCCTGAAGACACGGCCGTTTATTACTGTACTATTG GTGGCTCGTTAAGCCGTTCTTCACAGGGGACCCTGGTCACCGTCTC CTCA |
| HER3 MS001 54 | 418 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC TGGGGGTGGTCTGGTTCAGCCTGGTGGTAGCCTGCGTCTGAGCTGT GCAGCAAGCGGTAGCATTTTTCGTATTAATGCAATGGCATGGTATC GTCAGGCACCGGGTAAACAGCGTGAACTGGTTGCAGAAATTACCG CAGGCGGTAGCACCAATTATGCAGATAGCGTTAAAGGTCGCTTTAC CATTAGCCGTGATAATAGCTGGAATACCCTGTATCTGCAGATGAAT AGCCTGCGTCCTGAAGATACCGCAGTTTATTATTGCAACCTGGATC ATTATACCACCTGGGATCGTCGTAGCGCATATTGGGGTCAGGGGAC CCTGGTCACGGTCTCCTCCGGAGGCGGTGGGTCAGGTGGCGGAGG CAGCGGTGGAGGAGGTAGTGGCGGTGGCGGTAGTGGGGGTGGAG GCAGCGGAGGCGGAGGCAGTGGGGGCGGTGGATCCGAGGTGCAG TTGGTGGAGTCTGGGGGTGGTCTGGTTCAGCCTGGTGGTAGCCTGC GTCTGAGCTGTGCAGCAAGCGGTTTTACCTTTAGCAGCTATCCGAT GAGCTGGGTTCGTCAGGCACCGGGTAAAGGTCCGGCATGGGTTAG CACCGTTAGTCCGGGTGGTATTACAACCAGTTATGCAGATAGCGTT AAAGGTCGTTTTACCATTAGCCGTGATAATAGCAAAAATACCCTGT ATCTGCAGATGAATAGCCTGCGTCCTGAAGATACCGCAGTTTATTA TTGTCTGCGTGATCTGGGTAATCGTGGTCAGGGGACCCTGGTCACG GTCTCGAGCGGAGGCGGTGGGTCAGGTGGCGGAGGCAGCGGTGGA GGAGGTAGTGGCGGTGGCGGTAGTGGGGGTGGAGGCAGCGGAGG CGGAGGCAGTGGGGGCGGTGGCTCAGAGGTACAACTAGTGGAGTC |

Figure 1 (Continued):

| | | |
|---|---|---|
| | | TGGGGGTGGCTTGGTGCAACCGGGTAACAGTCTGCGCCTTAGCTGC GCAGCGTCTGGCTTTACCTTCAGCTCCTTTGGCATGAGCTGGGTTC GCCAGGCTCCGGGAAAAGGACTGGAATGGGTTTCGTCTATTAGCG GCAGTGGTAGCGATACGCTCTACGCGGACTCCGTGAAGGGCCGTTT CACCATCTCCGCGATAACGCCAAAACTACACTGTATCTGCAAATG AATAGCCTGCGTCCTGAAGACACGGCCGTTTATTACTGTACTATTG GTGGCTCGTTAAGCCGTTCTTCACAGGGGACCCTGGTCACCGTCTC CTCA |
| HER3 MS001 55 | 419 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAAGAGAGGTGCAATTGGTGGAGTC TGGGGGTGGTCTGGTTCAGCCTGGTGGTAGCCTGCGTCTGAGCTGT GCAGCAAGCGGTTTTACCTTTAGCAGCTATCCGATGAGCTGGGTTC GTCAGGCACCGGGTAAAGGTCCTGAATGGGTTAGCACCGTTAGTC CGGGTGGAATTACCACCAGTTATGCAGATAGCGTTAAAGGTCGTTT TACCATTAGCCGTGATAATAGCAAAAATACCCTGTATCTGCAGATG AATAGCCTGCGTCCTGAAGATACCGCAGTTTATTATTGTCTGCGTG ATCTGGGTAATCGTGGTCAGGGGACCCTGGTCACGGTCTCCTCCGG AGGCGGTGGGTCAGGTGGCGGAGGCAGCGGTGGAGGAGGTAGTG GCGGTGGCGGTAGTGGGGGTGGAGGCAGCGGAGGCGGAGGCAGT GGGGGCGGTGGATCCGAGGTGCAGTTGGTGGAGTCTGGGGGTGGC TTGGTGCAACCGGGTAACAGTCTGCGCCTTAGCTGCGCAGCGTCTG GCTTTACCTTCAGCTCCTTTGGCATGAGCTGGGTTCGCCAGGCTCC GGGAAAAGGACTGGAATGGGTTTCGTCTATTAGCGGCAGTGGTAG CGATACGCTCTACGCGGACTCCGTGAAGGGCCGTTTCACCATCTCC CGCGATAACGCCAAAACTACACTGTATCTGCAAATGAATAGCCTG CGTCCTGAAGACACGGCCGTTTATTACTGTACTATTGGTGGCTCGT TAAGCCGTTCTTCACAGGGGACCCTGGTCACGGTCTCGAGCGGAG GCGGTGGGTCAGGTGGCGGAGGCAGCGGTGGAGGAGGTAGTGGC GGTGGCGGTAGTGGGGGTGGAGGCAGCGGAGGCGGAGGCAGTGG GGGCGGTGGCTCAGAGGTACAACTAGTGGAGTCTGGGGGTGGTCT GGTTCAGCCTGGTGGTAGCCTGCGTCTGAGCTGTGCAGCAAGCGGC ACCCTGTTTAAAATTAATGCAATGGGTTGGTATCGCCAGGCACCGG GTAAACGTCGTGAACTGGTTGCACTGATTACCAGCAGCGATACCAC CGATTATGCAGAAGATGTTAAAGGTCGCTTTACCATTAGCCGTGAT AATAGCTGGAATACCGTTTATCTGCAGATGAATAGCCTGCGTCCTG AAGATACCGCAGTTTATTATTGTCACAGCGATCATTATAGCCTGGG TGTGCCGGAAAAACGTGTTATTCTGTATGGTCAGGGGACCCTGGTC ACCGTCTCCTCA |
| HER3 MS001 56 | 420 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG |

Figure 1 (Continued):

| | | |
|---|---|---|
| | | GGTTATTGTTTATAAATACTACTATTGCCAGCATTGCTGCTAAAGA<br>AGAAGGGGTATCTCTCGAGAAAAGAGAGGTGCAATTGGTGGAGTC<br>TGGGGGTGGTCTGGTTCAGCCTGGTGGTAGCCTGCGTCTGAGCTGT<br>GCAGCAAGCGGTTTTACCTTTAGCAGCTATCCGATGAGCTGGGTTC<br>GTCAGGCACCGGGTAAAGGTCCGGCATGGGTTAGCACCGTTAGTC<br>CGGGTGGTATTACAACCAGTTATGCAGATAGCGTTAAAGGTCGTTT<br>TACCATTAGCCGTGATAATAGCAAAAATACCCTGTATCTGCAGATG<br>AATAGCCTGCGTCCTGAAGATACCGCAGTTTATTATTGTCTGCGTG<br>ATCTGGGTAATCGTGGTCAGGGGACCCTGGTCACGGTCTCCTCCGG<br>AGGCGGTGGGTCAGGTGGCGGAGGCAGCGGTGGAGGAGGTAGTG<br>GCGGTGGCGGTAGTGGGGGTGGAGGCAGCGGAGGCGGAGGCAGT<br>GGGGGCGGTGGATCCGAGGTGCAGTTGGTGGAGTCTGGGGGTGGC<br>TTGGTGCAACCGGGTAACAGTCTGCGCCTTAGCTGCGCAGCGTCTG<br>GCTTTACCTTCAGCTCCTTTGGCATGAGCTGGGTTCGCCAGGCTCC<br>GGGAAAAGGACTGGAATGGGTTTCGTCTATTAGCGGCAGTGGTAG<br>CGATACGCTCTACGCGGACTCCGTGAAGGGCCGTTTCACCATCTCC<br>CGCGATAACGCCAAAACTACACTGTATCTGCAAATGAATAGCCTG<br>CGTCCTGAAGACACGGCCGTTTATTACTGTACTATTGGTGGCTCGT<br>TAAGCCGTTCTTCACAGGGGACCCTGGTCACGGTCTCGAGCGGAG<br>GCGGTGGGTCAGGTGGCGGAGGCAGCGGTGGAGGAGGTAGTGGC<br>GGTGGCGGTAGTGGGGGTGGAGGCAGCGGAGGCGGAGGCAGTGG<br>GGGCGGTGGCTCAGAGGTACAACTAGTGGAGTCTGGGGGTGGTCT<br>GGTTCAGCCTGGTGGTAGCCTGCGTCTGAGCTGTGCAGCAAGCGGC<br>ACCCTGTTTAAAATTAATGCAATGGGTTGGTATCGCCAGGCACCGG<br>GTAAACGTCGTGAACTGGTTGCACTGATTACCAGCAGCGATACCAC<br>CGATTATGCAGAAGATGTTAAAGGTCGCTTTACCATTAGCCGTGAT<br>AATAGCTGGAATACCGTTTATCTGCAGATGAATAGCCTGCGTCCTG<br>AAGATACCGCAGTTTATTATTGTCACAGCGATCATTATAGCCTGGG<br>TGTGCCGGAAAAACGTGTTATTCTGTATGGTCAGGGGACCCTGGTC<br>ACCGTCTCCTCA |
| HER3<br>MS001<br>57 | 421 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGGTGCAATTGGTGGAGTC<br>TGGGGGTGGTCTGGTTCAGCCTGGTGGTAGCCTGCGTCTGAGCTGT<br>GCAGCAAGCGGTTTTACCTTTAGCAGCTATCCGATGAGCTGGGTTC<br>GTCAGGCACCGGGTAAAGGTCCTGAATGGGTTAGCACCGTTAGTC<br>CGGGTGGAATTACCACCAGTTATGCAGATAGCGTTAAAGGTCGTTT<br>TACCATTAGCCGTGATAATAGCAAAAATACCCTGTATCTGCAGATG<br>AATAGCCTGCGTCCTGAAGATACCGCAGTTTATTATTGTCTGCGTG<br>ATCTGGGTAATCGTGGTCAGGGGACCCTGGTCACGGTCTCCTCCGG<br>AGGCGGTGGGTCAGGTGGCGGAGGCAGCGGTGGAGGAGGTAGTG<br>GCGGTGGCGGTAGTGGGGGTGGAGGCAGCGGAGGCGGAGGCAGT<br>GGGGGCGGTGGATCCGAGGTGCAGTTGGTGGAGTCTGGGGGTGGT |

Figure 1 (Continued):

| | | |
|---|---|---|
| | | CTGGTTCAGCCTGGTGGTAGCCTGCGTCTGAGCTGTGCAGCAAGCG |
| | | GCACCCTGTTTAAAATTAATGCAATGGGTTGGTATCGCCAGGCACC |
| | | GGGTAAACGTCGTGAACTGGTTGCACTGATTACCAGCAGCGATAC |
| | | CACCGATTATGCAGAAGATGTTAAAGGTCGCTTTACCATTAGCCGT |
| | | GATAATAGCTGGAATACCGTTTATCTGCAGATGAATAGCCTGCGTC |
| | | CTGAAGATACCGCAGTTTATTATTGTCACAGCGATCATTATAGCCT |
| | | GGGTGTGCCGGAAAACGTGTTATTCTGTATGGTCAGGGGACCCTG |
| | | GTCACGGTCTCGAGCGGAGGCGGTGGGTCAGGTGGCGGAGGCAGC |
| | | GGTGGAGGAGGTAGTGGCGGTGGCGGTAGTGGGGGTGGAGGCAG |
| | | CGGAGGCGGAGGCAGTGGGGGCGGTGGCTCAGAGGTACAACTAGT |
| | | GGAGTCTGGGGGTGGCTTGGTGCAACCGGGTAACAGTCTGCGCCTT |
| | | AGCTGCGCAGCGTCTGGCTTTACCTTCAGCTCCTTTGGCATGAGCT |
| | | GGGTTCGCCAGGCTCCGGGAAAAGGACTGGAATGGGTTTCGTCTA |
| | | TTAGCGGCAGTGGTAGCGATACGCTCTACGCGGACTCCGTGAAGG |
| | | GCCGTTTCACCATCTCCCGCGATAACGCCAAAACTACACTGTATCT |
| | | GCAAATGAATAGCCTGCGTCCTGAAGACACGGCCGTTTATTACTGT |
| | | ACTATTGGTGGCTCGTTAAGCCGTTCTTCACAGGGGACCCTGGTCA |
| | | CCGTCTCCTCA |
| HER3 MS001 58 | 422 | ATGAGATTTCCTTCAATTTTTACTGCTGTTTTATTCGCAGCATCCTC |
| | | CGCATTAGCTGCTCCAGTCAACACTACAACAGAAGATGAAACGGC |
| | | ACAAATTCCGGCTGAAGCTGTCATCGGTTACTCAGATTTAGAAGGG |
| | | GATTTCGATGTTGCTGTTTTGCCATTTTCCAACAGCACAAATAACG |
| | | GGTTATTGTTTATAAATACTACTATTGCCAGCATTGCTGCTAAAGA |
| | | AGAAGGGGTATCTCTCGAAAAGAGAGAGGTGCAATTGGTGGAGTC |
| | | TGGGGGTGGTCTGGTTCAGCCTGGTGGTAGCCTGCGTCTGAGCTGT |
| | | GCAGCAAGCGGTTTTACCTTTAGCAGCTATCCGATGAGCTGGGTTC |
| | | GTCAGGCACCGGGTAAAGGTCCGGCATGGGTTAGCACCGTTAGTC |
| | | CGGGTGGTATTACAACCAGTTATGCAGATAGCGTTAAAGGTCGTTT |
| | | TACCATTAGCCGTGATAATAGCAAAAATACCCTGTATCTGCAGATG |
| | | AATAGCCTGCGTCCTGAAGATACCGCAGTTTATTATTGTCTGCGTG |
| | | ATCTGGGTAATCGTGGTCAGGGGACCCTGGTCACGGTCTCCTCCGG |
| | | AGGCGGTGGGTCAGGTGGCGGAGGCAGCGGTGGAGGAGGTAGTG |
| | | GCGGTGGCGGTAGTGGGGGTGGAGGCAGCGGAGGCGGAGGCAGT |
| | | GGGGGCGGTGGATCCGAGGTGCAGTTGGTGGAGTCTGGGGGTGGT |
| | | CTGGTTCAGCCTGGTGGTAGCCTGCGTCTGAGCTGTGCAGCAAGCG |
| | | GCACCCTGTTTAAAATTAATGCAATGGGTTGGTATCGCCAGGCACC |
| | | GGGTAAACGTCGTGAACTGGTTGCACTGATTACCAGCAGCGATAC |
| | | CACCGATTATGCAGAAGATGTTAAAGGTCGCTTTACCATTAGCCGT |
| | | GATAATAGCTGGAATACCGTTTATCTGCAGATGAATAGCCTGCGTC |
| | | CTGAAGATACCGCAGTTTATTATTGTCACAGCGATCATTATAGCCT |
| | | GGGTGTGCCGGAAAACGTGTTATTCTGTATGGTCAGGGGACCCTG |
| | | GTCACGGTCTCGAGCGGAGGCGGTGGGTCAGGTGGCGGAGGCAGC |
| | | GGTGGAGGAGGTAGTGGCGGTGGCGGTAGTGGGGGTGGAGGCAG |
| | | CGGAGGCGGAGGCAGTGGGGGCGGTGGCTCAGAGGTACAACTAGT |
| | | GGAGTCTGGGGGTGGCTTGGTGCAACCGGGTAACAGTCTGCGCCTT |
| | | AGCTGCGCAGCGTCTGGCTTTACCTTCAGCTCCTTTGGCATGAGCT |

Figure 1 (Continued):

| | | |
|---|---|---|
| | | GGGTTCGCCAGGCTCCGGGAAAAGGACTGGAATGGGTTTCGTCTA TTAGCGGCAGTGGTAGCGATACGCTCTACGCGGACTCCGTGAAGG GCCGTTTCACCATCTCCCGCGATAACGCCAAAACTACACTGTATCT GCAAATGAATAGCCTGCGTCCTGAAGACACGGCCGTTTATTACTGT ACTATTGGTGGCTCGTTAAGCCGTTCTTCACAGGGGACCCTGGTCA CCGTCTCCTCA |
| HER3 MS001 59 | 423 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC TGGGGGTGGTCTGGTTCAGCCTGGTGGTAGCCTGCGTCTGAGCTGT GCAGCAAGCGGCACCCTGTTTAAAATTAATGCAATGGGTTGGTATC GCCAGGCACCGGGTAAACGTCGTGAACTGGTTGCACTGATTACCA GCAGCGATACCACCGATTATGCAGAAGATGTTAAAGGTCGCTTTAC CATTAGCCGTGATAATAGCTGGAATACCGTTTATCTGCAGATGAAT AGCCTGCGTCCTGAAGATACCGCAGTTTATTATTGTCACAGCGATC ATTATAGCCTGGGTGTGCCGGAAAAACGTGTTATTCTGTATGGTCA GGGGACCCTGGTCACGGTCTCCTCCGGAGGCGGTGGGTCAGGTGG CGGAGGCAGCGGTGGAGGAGGTAGTGGCGGTGGCGGTAGTGGGG GTGGAGGCAGCGGAGGCGGAGGCAGTGGGGGCGGTGGATCCGAG GTGCAGTTGGTGGAGTCTGGGGGTGGCTTGGTGCAACCGGGTAAC AGTCTGCGCCTTAGCTGCGCAGCGTCTGGCTTTACCTTCAGCTCCTT TGGCATGAGCTGGGTTCGCCAGGCTCCGGGAAAAGGACTGGAATG GGTTTCGTCTATTAGCGGCAGTGGTAGCGATACGCTCTACGCGGAC TCCGTGAAGGGCCGTTTCACCATCTCCCGCGATAACGCCAAAACTA CACTGTATCTGCAAATGAATAGCCTGCGTCCTGAAGACACGGCCGT TTATTACTGTACTATTGGTGGCTCGTTAAGCCGTTCTTCACAGGGG ACCCTGGTCACGGTCTCGAGCGGAGGCGGTGGGTCAGGTGGCGGA GGCAGCGGTGGAGGAGGTAGTGGCGGTGGCGGTAGTGGGGGTGG AGGCAGCGGAGGCGGAGGCAGTGGGGGCGGTGGCTCAGAGGTAC AACTAGTGGAGTCTGGGGGTGGTCTGGTTCAGCCTGGTGGTAGCCT GCGTCTGAGCTGTGCAGCAAGCGGTTTTACCTTTAGCAGCTATCCG ATGAGCTGGGTTCGTCAGGCACCGGGTAAAGGTCCTGAATGGGTT AGCACCGTTAGTCCGGGTGGAATTACCACCAGTTATGCAGATAGC GTTAAAGGTCGTTTTACCATTAGCCGTGATAATAGCAAAAATACCC TGTATCTGCAGATGAATAGCCTGCGTCCTGAAGATACCGCAGTTTA TTATTGTCTGCGTGATCTGGGTAATCGTGGTCAGGGGACCCTGGTC ACCGTCTCCTCA |
| HER3 MS001 60 | 424 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAGAAAGAGAGGTGCAATTGGTGGAGTC |

Figure 1 (Continued):

| | | |
|---|---|---|
| | | TGGGGGTGGTCTGGTTCAGCCTGGTGGTAGCCTGCGTCTGAGCTGT GCAGCAAGCGGCACCCTGTTTAAAATTAATGCAATGGGTTGGTATC GCCAGGCACCGGGTAAACGTCGTGAACTGGTTGCACTGATTACCA GCAGCGATACCACCGATTATGCAGAAGATGTTAAAGGTCGCTTTAC CATTAGCCGTGATAATAGCTGGAATACCGTTTATCTGCAGATGAAT AGCCTGCGTCCTGAAGATACCGCAGTTTATTATTGTCACAGCGATC ATTATAGCCTGGGTGTGCCGGAAAAACGTGTTATTCTGTATGGTCA GGGGACCCTGGTCACGGTCTCCTCCGGAGGCGGTGGGTCAGGTGG CGGAGGCAGCGGTGGAGGAGGTAGTGGCGGTGGCGGTAGTGGGG GTGGAGGCAGCGGAGGCGGAGGCAGTGGGGGCGGTGGATCCGAG GTGCAGTTGGTGGAGTCTGGGGGTGGCTTGGTGCAACCGGGTAAC AGTCTGCGCCTTAGCTGCGCAGCGTCTGGCTTTACCTTCAGCTCCTT TGGCATGAGCTGGGTTCGCCAGGCTCCGGGAAAAGGACTGGAATG GGTTTCGTCTATTAGCGGCAGTGGTAGCGATACGCTCTACGCGGAC TCCGTGAAGGGCCGTTTCACCATCTCCCGCGATAACGCCAAAACTA CACTGTATCTGCAAATGAATAGCCTGCGTCCTGAAGACACGGCCGT TTATTACTGTACTATTGGTGGCTCGTTAAGCCGTTCTTCACAGGGG ACCCTGGTCACGGTCTCGAGCGGAGGCGGTGGGTCAGGTGGCGGA GGCAGCGGTGGAGGAGGTAGTGGCGGTGGCGGTAGTGGGGGTGG AGGCAGCGGAGGCGGAGGCAGTGGGGGCGGTGGCTCAGAGGTAC AACTAGTGGAGTCTGGGGGTGGTCTGGTTCAGCCTGGTGGTAGCCT GCGTCTGAGCTGTGCAGCAAGCGGTTTTACCTTTAGCAGCTATCCG ATGAGCTGGGTTCGTCAGGCACCGGGTAAAGGTCCGGCATGGGTT AGCACCGTTAGTCCGGGTGGTATTACAACCAGTTATGCAGATAGCG TTAAAGGTCGTTTTACCATTAGCCGTGATAATAGCAAAAATACCCT GTATCTGCAGATGAATAGCCTGCGTCCTGAAGATACCGCAGTTTAT TATTGTCTGCGTGATCTGGGTAATCGTGGTCAGGGGACCCTGGTCA CCGTCTCCTCA |
| HER3 MS001 61 | 425 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGCACCCTGTTTAAAATTAATGCAATGGGTTGGTATC GCCAGGCACCGGGTAAACGTCGTGAACTGGTTGCACTGATTACCA GCAGCGATACCACCGATTATGCAGAAGATGTTAAAGGTCGCTTTAC CATTAGCCGTGATAATAGCTGGAATACCGTTTATCTGCAGATGAAT AGCCTGCGTCCTGAAGATACCGCAGTTTATTATTGTCACAGCGATC ATTATAGCCTGGGTGTGCCGGAAAAACGTGTTATTCTGTATGGTCA GGGGACCCTGGTCACGGTCTCCTCCGGAGGCGGTGGGTCAGGTGG CGGAGGCAGCGGTGGAGGAGGTAGTGGCGGTGGCGGTAGTGGGG GTGGAGGCAGCGGAGGCGGAGGCAGTGGGGGCGGTGGATCCGAG GTGCAGTTGGTGGAGTCTGGGGGTGGTCTGGTTCAGCCTGGTGGTA GCCTGCGTCTGAGCTGTGCAGCAAGCGGTTTTACCTTTAGCAGCTA |

Figure 1 (Continued):

| | | |
|---|---|---|
| | | TCCGATGAGCTGGGTTCGTCAGGCACCGGGTAAAGGTCCTGAATG<br>GGTTAGCACCGTTAGTCCGGGTGGAATTACCACCAGTTATGCAGAT<br>AGCGTTAAAGGTCGTTTTACCATTAGCCGTGATAATAGCAAAAATA<br>CCCTGTATCTGCAGATGAATAGCCTGCGTCCTGAAGATACCGCAGT<br>TTATTATTGTCTGCGTGATCTGGGTAATCGTGGTCAGGGGACCCTG<br>GTCACGGTCTCGAGCGGAGGCGGTGGGTCAGGTGGCGGAGGCAGC<br>GGTGGAGGAGGTAGTGGCGGTGGCGGTAGTGGGGGTGGAGGCAG<br>CGGAGGCGGAGGCAGTGGGGGCGGTGGCTCAGAGGTACAACTAGT<br>GGAGTCTGGGGGTGGCTTGGTGCAACCGGGTAACAGTCTGCGCCTT<br>AGCTGCGCAGCGTCTGGCTTTACCTTCAGCTCCTTTGGCATGAGCT<br>GGGTTCGCCAGGCTCCGGGAAAAGGACTGGAATGGGTTTCGTCTA<br>TTAGCGGCAGTGGTAGCGATACGCTCTACGCGGACTCCGTGAAGG<br>GCCGTTTCACCATCTCCCGCGATAACGCCAAAACTACACTGTATCT<br>GCAAATGAATAGCCTGCGTCCTGAAGACACGGCCGTTTATTACTGT<br>ACTATTGGTGGCTCGTTAAGCCGTTCTTCACAGGGGACCCTGGTCA<br>CCGTCTCCTCA |
| HER3<br>MS001<br>62 | 426 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGAGGTGCAATTGGTGGAGTC<br>TGGGGGTGGTCTGGTTCAGCCTGGTGGTAGCCTGCGTCTGAGCTGT<br>GCAGCAAGCGGCACCCTGTTTAAAATTAATGCAATGGGTTGGTATC<br>GCCAGGCACCGGGTAAACGTCGTGAACTGGTTGCACTGATTACCA<br>GCAGCGATACCACCGATTATGCAGAAGATGTTAAAGGTCGCTTTAC<br>CATTAGCCGTGATAATAGCTGGAATACCGTTTATCTGCAGATGAAT<br>AGCCTGCGTCCTGAAGATACCGCAGTTTATTATTGTCACAGCGATC<br>ATTATAGCCTGGGTGTGCCGGAAAAACGTGTTATTCTGTATGGTCA<br>GGGGACCCTGGTCACGGTCTCCTCCGGAGGCGGTGGGTCAGGTGG<br>CGGAGGCAGCGGTGGAGGAGGTAGTGGCGGTGGCGGTAGTGGGG<br>GTGGAGGCAGCGGAGGCGGAGGCAGTGGGGGCGGTGGATCCGAG<br>GTGCAGTTGGTGGAGTCTGGGGGTGGTCTGGTTCAGCCTGGTGGTA<br>GCCTGCGTCTGAGCTGTGCAGCAAGCGGTTTTACCTTTAGCAGCTA<br>TCCGATGAGCTGGGTTCGTCAGGCACCGGGTAAAGGTCCGGCATG<br>GGTTAGCACCGTTAGTCCGGGTGGTATTACAACCAGTTATGCAGAT<br>AGCGTTAAAGGTCGTTTTACCATTAGCCGTGATAATAGCAAAAATA<br>CCCTGTATCTGCAGATGAATAGCCTGCGTCCTGAAGATACCGCAGT<br>TTATTATTGTCTGCGTGATCTGGGTAATCGTGGTCAGGGGACCCTG<br>GTCACGGTCTCGAGCGGAGGCGGTGGGTCAGGTGGCGGAGGCAGC<br>GGTGGAGGAGGTAGTGGCGGTGGCGGTAGTGGGGGTGGAGGCAG<br>CGGAGGCGGAGGCAGTGGGGGCGGTGGCTCAGAGGTACAACTAGT<br>GGAGTCTGGGGGTGGCTTGGTGCAACCGGGTAACAGTCTGCGCCTT<br>AGCTGCGCAGCGTCTGGCTTTACCTTCAGCTCCTTTGGCATGAGCT<br>GGGTTCGCCAGGCTCCGGGAAAAGGACTGGAATGGGTTTCGTCTA<br>TTAGCGGCAGTGGTAGCGATACGCTCTACGCGGACTCCGTGAAGG |

Figure 1 (Continued):

| | | |
|---|---|---|
| | | GCCGTTTCACCATCTCCCGCGATAACGCCAAAACTACACTGTATCT GCAAATGAATAGCCTGCGTCCTGAAGACACGGCCGTTTATTACTGT ACTATTGGTGGCTCGTTAAGCCGTTCTTCACAGGGGACCCTGGTCA CCGTCTCCTCA |
| HER3 MS001 99 | 427 | ATGAGATTTCCTTCAATTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGCACCCTGTTTAAAATTAATGCAATGGGTTGGTATC GCCAGGCACCGGGTAAACGTCGTGAACTGGTTGCACTGATTACCA GCAGCGATACCACCGATTATGCAGAAGATGTTAAGGTCGCTTTAC CATTAGCCGTGATAATAGCTGGAATACCGTTTATCTGCAGATGAAT AGCCTGCGTCCTGAAGATACCGCAGTTTATTATTGTCACAGCGATC ATTATAGCCTGGGTGTGCCGGAAAAACGTGTTATTCTGTATGGTCA GGGGACCCTGGTCACGGTCTCCTCAGGAGGTGGCGGATCCGGCGG AGGTAGTGAGGTGCAGCTGGTGGAGTCTGGGGGTGGCTTGGTGCA ACCGGGTAACAGTCTGCGCCTTAGCTGCGCAGCGTCTGGCTTTACC TTCAGCTCCTTTGGCATGAGCTGGGTTCGCCAGGCTCCGGGAAAAG GACTGGAATGGGTTTCGTCTATTAGCGGCAGTGGTAGCGATACGCT CTACGCGGACTCCGTGAAGGGCCGTTTCACCATCTCCCGCGATAAC GCCAAAACTACACTGTATCTGCAAATGAATAGCCTGCGTCCTGAAG ACACGGCCGTTTATTACTGTACTATTGGTGGCTCGTTAAGCCGTTCT TCACAGGGGACCCTGGTCACGGTCTCCTCAGGAGGTGGCGGGTCC GGAGGAGGTAGTGAGGTGCAGCTGGTGGAGTCTGGGGGTGGTCTG GTTCAGCCTGGTGGTAGCCTGCGTCTGAGCTGTGCAGCAAGCGGTC GTACCTATTATCTGAATGCAATGGGTTGGTTTCGTCAGGCACCGGG TAAAGAACGTGAATTTGTTGCAGCCATTGATTGGAGCGAAGGCAA TAAAGATTATGCCGATAGCGTGAAAGGTCGTTTTACCATTAGCCGT GATGCTAGCAAAAACACCGTTTATCTGCAGATGAATAGCCTGCGTC CTGAAGATACCGCAGTTTATTATTGTGCAGCAGATACCCCTCCGTG GGGTCCGCTGATTTATATTGAAAGCTATGATAGCTGGGGTCAGGGG ACCCTGGTCACCGTCTCCTCA |
| HER3 MS002 00 | 428 | ATGAGATTTCCTTCAATTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGCACCCTGTTTAAAATTAATGCAATGGGTTGGTATC GCCAGGCACCGGGTAAACGTCGTGAACTGGTTGCACTGATTACCA GCAGCGATACCACCGATTATGCAGAAGATGTTAAGGTCGCTTTAC CATTAGCCGTGATAATAGCTGGAATACCGTTTATCTGCAGATGAAT |

Figure 1 (Continued):

| | | |
|---|---|---|
| | | AGCCTGCGTCCTGAAGATACCGCAGTTTATTATTGTCACAGCGATC<br>ATTATAGCCTGGGTGTGCCGGAAAAACGTGTTATTCTGTATGGTCA<br>GGGGACCCTGGTCACGGTCTCCTCAGGAGGTGGCGGATCCGGCGG<br>AGGTAGTGAGGTGCAGCTGGTGGAGTCTGGGGGTGGTCTGGTTCA<br>GCCTGGTGGTAGCCTGCGTCTGAGCTGTGCAGCAAGCGGTCGTACC<br>TATTATCTGAATGCAATGGGTTGGTTTCGTCAGGCACCGGGTAAAG<br>AACGTGAATTTGTTGCAGCCATTGATTGGAGCGAAGGCAATAAAG<br>ATTATGCCGATAGCGTGAAAGGTCGTTTTACCATTAGCCGTGATGC<br>TAGCAAAAACACCGTTTATCTGCAGATGAATAGCCTGCGTCCTGAA<br>GATACCGCAGTTTATTATTGTGCAGCAGATACCCCTCCGTGGGGTC<br>CGCTGATTTATATTGAAAGCTATGATAGCTGGGGTCAGGGGACCCT<br>GGTCACGGTCTCCTCAGGAGGTGGCGGGTCCGGAGGAGGTAGTGA<br>GGTGCAGCTGGTGGAGTCTGGGGGTGGCTTGGTGCAACCGGGTAA<br>CAGTCTGCGCCTTAGCTGCGCAGCGTCTGGCTTTACCTTCAGCTCCT<br>TTGGCATGAGCTGGGTTCGCCAGGCTCCGGGAAAAGGACTGGAAT<br>GGGTTTCGTCTATTAGCGGCAGTGGTAGCGATACGCTCTACGCGGA<br>CTCCGTGAAGGGCCGTTTCACCATCTCCCGCGATAACGCCAAAACT<br>ACACTGTATCTGCAAATGAATAGCCTGCGTCCTGAAGACACGGCC<br>GTTTATTACTGTACTATTGGTGGCTCGTTAAGCCGTTCTTCACAGGG<br>GACCCTGGTCACCGTCTCCTCA |
| HER3<br>MS002<br>01 | 429 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGAGGTGCAATTGGTGGAGTC<br>TGGGGGTGGTCTGGTTCAGCCTGGTGGTAGCCTGCGTCTGAGCTGT<br>GCAGCAAGCGGTCGTACCTATTATCTGAATGCAATGGGTTGGTTTC<br>GTCAGGCACCGGGTAAAGAACGTGAATTTGTTGCAGCCATTGATTG<br>GAGCGAAGGCAATAAAGATTATGCCGATAGCGTGAAAGGTCGTTT<br>TACCATTAGCCGTGATGCTAGCAAAAACACCGTTTATCTGCAGATG<br>AATAGCCTGCGTCCTGAAGATACCGCAGTTTATTATTGTGCAGCAG<br>ATACCCCTCCGTGGGGTCCGCTGATTTATATTGAAAGCTATGATAG<br>CTGGGGTCAGGGGACCCTGGTCACGGTCTCCTCAGGAGGTGGCGG<br>ATCCGGCGGAGGTAGTGAGGTGCAGCTGGTGGAGTCTGGGGGTGG<br>CTTGGTGCAACCGGGTAACAGTCTGCGCCTTAGCTGCGCAGCGTCT<br>GGCTTTACCTTCAGCTCCTTTGGCATGAGCTGGGTTCGCCAGGCTC<br>CGGGAAAAGGACTGGAATGGGTTTCGTCTATTAGCGGCAGTGGTA<br>GCGATACGCTCTACGCGGACTCCGTGAAGGGCCGTTTCACCATCTC<br>CCGCGATAACGCCAAAACTACACTGTATCTGCAAATGAATAGCCT<br>GCGTCCTGAAGACACGGCCGTTTATTACTGTACTATTGGTGGCTCG<br>TTAAGCCGTTCTTCACAGGGGACCCTGGTCACGGTCTCCTCAGGAG<br>GTGGCGGGTCCGGAGGAGGTAGTGAGGTGCAGCTGGTGGAGTCTG<br>GGGGTGGTCTGGTTCAGCCTGGTGGTAGCCTGCGTCTGAGCTGTGC<br>AGCAAGCGGCACCCTGTTTAAAATTAATGCAATGGGTTGGTATCGC<br>CAGGCACCGGGTAAACGTCGTGAACTGGTTGCACTGATTACCAGC |

Figure 1 (Continued):

| | | |
|---|---|---|
| | | AGCGATACCACCGATTATGCAGAAGATGTTAAAGGTCGCTTTACCA<br>TTAGCCGTGATAATAGCTGGAATACCGTTTATCTGCAGATGAATAG<br>CCTGCGTCCTGAAGATACCGCAGTTTATTATTGTCACAGCGATCAT<br>TATAGCCTGGGTGTGCCGGAAAAACGTGTTATTCTGTATGGTCAGG<br>GGACCCTGGTCACCGTCTCCTCA |
| HER3<br>MS002<br>02 | 430 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGAGGTGCAATTGGTGGAGTC<br>TGGGGGTGGTCTGGTTCAGCCTGGTGGTAGCCTGCGTCTGAGCTGT<br>GCAGCAAGCGGTCGTACCTATTATCTGAATGCAATGGGTTGGTTTC<br>GTCAGGCACCGGGTAAAGAACGTGAATTTGTTGCAGCCATTGATTG<br>GAGCGAAGGCAATAAAGATTATGCCGATAGCGTGAAAGGTCGTTT<br>TACCATTAGCCGTGATGCTAGCAAAAACACCGTTTATCTGCAGATG<br>AATAGCCTGCGTCCTGAAGATACCGCAGTTTATTATTGTGCAGCAG<br>ATACCCCTCCGTGGGGTCCGCTGATTTATATTGAAAGCTATGATAG<br>CTGGGGTCAGGGGACCCTGGTCACGGTCTCCTCAGGAGGTGGCGG<br>ATCCGGCGGAGGTAGTGAGGTGCAGCTGGTGGAGTCTGGGGGTGG<br>TCTGGTTCAGCCTGGTGGTAGCCTGCGTCTGAGCTGTGCAGCAAGC<br>GGCACCCTGTTTAAAATTAATGCAATGGGTTGGTATCGCCAGGCAC<br>CGGGTAAACGTCGTGAACTGGTTGCACTGATTACCAGCAGCGATA<br>CCACCGATTATGCAGAAGATGTTAAAGGTCGCTTTACCATTAGCCG<br>TGATAATAGCTGGAATACCGTTTATCTGCAGATGAATAGCCTGCGT<br>CCTGAAGATACCGCAGTTTATTATTGTCACAGCGATCATTATAGCC<br>TGGGTGTGCCGGAAAAACGTGTTATTCTGTATGGTCAGGGGACCCT<br>GGTCACGGTCTCCTCAGGAGGTGGCGGGTCCGGAGGAGGTAGTGA<br>GGTGCAGCTGGTGGAGTCTGGGGGTGGCTTGGTGCAACCGGGTAA<br>CAGTCTGCGCCTTAGCTGCGCAGCGTCTGGCTTTACCTTCAGCTCCT<br>TTGGCATGAGCTGGGTTCGCCAGGCTCCGGGAAAAGGACTGGAAT<br>GGGTTTCGTCTATTAGCGGCAGTGGTAGCGATACGCTCTACGCGGA<br>CTCCGTGAAGGGCCGTTTCACCATCTCCCGCGATAACGCCAAAACT<br>ACACTGTATCTGCAAATGAATAGCCTGCGTCCTGAAGACACGGCC<br>GTTTATTACTGTACTATTGGTGGCTCGTTAAGCCGTTCTTCACAGGG<br>GACCCTGGTCACCGTCTCCTCA |
| HER3<br>MS002<br>07 | 431 | ATGAGATTTCCTTCAATTTTTACTGCTGTTTTATTCGCAGCATCCTC<br>CGCATTAGCTGCTCCAGTCAACACTACAACAGAAGATGAAACGGC<br>ACAAATTCCGGCTGAAGCTGTCATCGGTTACTCAGATTTAGAAGGG<br>GATTTCGATGTTGCTGTTTTGCCATTTTCCAACAGCACAAATAACG<br>GGTTATTGTTTATAAATACTACTATTGCCAGCATTGCTGCTAAAGA<br>AGAAGGGGTATCTCTCGAAAAGAGAGAGGTGCAATTGGTGGAGTC<br>TGGGGGTGGTCTGGTTCAGCCTGGTGGTAGCCTGCGTCTGAGCTGT<br>GCAGCAAGCGGCACCCTGTTTAAAATTAATGCAATGGGTTGGTATC<br>GCCAGGCACCGGGTAAACGTCGTGAACTGGTTGCACTGATTACCA<br>GCAGCGATACCACCGATTATGCAGAAGATGTTAAAGGTCGCTTTAC |

Figure 1 (Continued):

| | | |
|---|---|---|
| | | CATTAGCCGTGATAATAGCTGGAATACCGTTTATCTGCAGATGAAT AGCCTGCGTCCTGAAGATACCGCAGTTTATTATTGTCACAGCGATC ATTATAGCCTGGGTGTGCCGGAAAAACGTGTTATTCTGTATGGTCA GGGGACCCTGGTCACGGTCTCCTCAGGAGGTGGCGGATCCGGCGG AGGTAGTGAGGTGCAGCTGGTGGAGTCTGGGGGTGGCTTGGTGCA ACCGGGTAACAGTCTGCGCCTTAGCTGCGCAGCGTCTGGCTTTACC TTCAGCTCCTTTGGCATGAGCTGGGTTCGCCAGGCTCCGGGAAAAG GACTGGAATGGGTTTCGTCTATTAGCGGCAGTGGTAGCGATACGCT CTACGCGGACTCCGTGAAGGGCCGTTTCACCATCTCCCGCGATAAC GCCAAAACTACACTGTATCTGCAAATGAATAGCCTGCGTCCTGAAG ACACGGCCGTTTATTACTGTACTATTGGTGGCTCGTTAAGCCGTTCT TCACAGGGGACCCTGGTCACGGTCTCCTCAGGAGGTGGCGGGTCC GGAGGAGGTAGTGAGGTGCAGCTGGTGGAGTCTGGGGGTGGTCTG GTTCAGCCTGGTGGTAGCCTGCGTCTGAGCTGTGCAGCAAGCGGTA GCATTGGTGGTCTGAATGCAATGGCATGGTATCGTCAGGCACCGG GTAAAGAACGTGAACTGGTTGCAGGTATTTTTGGTGTTGGTAGCAC CCGTTATGCAGATAGCGTTAAAGGTCGTTTTACCATTAGCCGTGAC AATAGCAAAACACCGTTTATCTGCAGATGAATAGCCTGCGTCCTG AAGATACCGCAGTTTATTATTGTCGCATGAGCAGCGTTACCCGTGG TAGCAGCGATTATTGGGGTCAGGGGACCCTGGTCACCGTCTCCTCA |
| HER3 MS002 08 | 432 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGTTTTACCTTTAGCAGCTATCCGATGAGCTGGGTTC GTCAGGCACCGGGTAAAGGTCCTGAATGGGTTAGCACCGTTAGTC GGGGTGGAATTACCACCAGTTATGCAGATAGCGTTAAAGGTCGTTT TACCATTAGCCGTGATAATAGCAAAAATACCCTGTATCTGCAGATG AATAGCCTGCGTCCTGAAGATACCGCAGTTTATTATTGTCTGCGTG ATCTGGGTAATCGTGGTCAGGGGACCCTGGTCACGGTCTCCTCAGG AGGTGGCGGATCCGGCGGAGGTAGTGAGGTGCAGCTGGTGGAGTC TGGGGGTGGCTTGGTGCAACCGGGTAACAGTCTGCGCCTTAGCTGC GCAGCGTCTGGCTTTACCTTCAGCTCCTTTGGCATGAGCTGGGTTC GCCAGGCTCCGGGAAAAGGACTGGAATGGGTTTCGTCTATTAGCG GCAGTGGTAGCGATACGCTCTACGCGGACTCCGTGAAGGGCCGTTT CACCATCTCCCGCGATAACGCCAAAACTACACTGTATCTGCAAATG AATAGCCTGCGTCCTGAAGACACGGCCGTTTATTACTGTACTATTG GTGGCTCGTTAAGCCGTTCTTCACAGGGGACCCTGGTCACGGTCTC CTCAGGAGGTGGCGGGTCCGGAGGAGGTAGTGAGGTGCAGCTGGT GGAGTCTGGGGGTGGTCTGGTTCAGCCTGGTGGTAGCCTGCGTCTG AGCTGTGCAGCAAGCGGCACCCTGTTTAAAATTAATGCAATGGGTT GGTATCGCCAGGCACCGGGTAAACGTCGTGAACTGGTTGCACTGA TTACCAGCAGCGATACCACCGATTATGCAGAAGATGTTAAAGGTC |

Figure 1 (Continued):

| | | |
|---|---|---|
| | | GCTTTACCATTAGCCGTGATAATAGCTGGAATACCGTTTATCTGCA GATGAATAGCCTGCGTCCTGAAGATACCGCAGTTTATTATTGTCAC AGCGATCATTATAGCCTGGGTGTGCCGGAAAAACGTGTTATTCTGT ATGGTCAGGGGACCCTGGTCACCGTCTCCTCA |
| HER3 MS002 09 | 433 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC TGGGGGTGGTCTGGTTCAGCCTGGTGGTAGCCTGCGTCTGAGCTGT GCAGCAAGCGGTAGCATTGGTGGTCTGAATGCAATGGCATGGTAT CGTCAGGCACCGGGTAAAGAACGTGAACTGGTTGCAGGTATTTTTG GTGTTGGTAGCACCCGTTATGCAGATAGCGTTAAAGGTCGTTTTAC CATTAGCCGTGACAATAGCAAAAACACCGTTTATCTGCAGATGAAT AGCCTGCGTCCTGAAGATACCGCAGTTTATTATTGTCGCATGAGCA GCGTTACCCGTGGTAGCAGCGATTATTGGGGTCAGGGGACCCTGGT CACGGTCTCCTCAGGAGGTGGCGGATCCGGCGGAGGTAGTGAGGT GCAGCTGGTGGAGTCTGGGGGTGGCTTGGTGCAACCGGGTAACAG TCTGCGCCTTAGCTGCGCAGCGTCTGGCTTTACCTTCAGCTCCTTTG GCATGAGCTGGGTTCGCCAGGCTCCGGGAAAAGGACTGGAATGGG TTTCGTCTATTAGCGGCAGTGGTAGCGATACGCTCTACGCGGACTC CGTGAAGGGCCGTTTCACCATCTCCCGCGATAACGCCAAAACTACA CTGTATCTGCAAATGAATAGCCTGCGTCCTGAAGACACGGCCGTTT ATTACTGTACTATTGGTGGCTCGTTAAGCCGTTCTTCACAGGGGAC CCTGGTCACCGTCTCCTCA |
| HER3 MS002 10 | 434 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGTCGTACCTATTATCTGAATGCAATGGGTTGGTTTC GTCAGGCACCGGGTAAAGAACGTGAATTTGTTGCAGCCATTGATTG GAGCGAAGGCAATAAAGATTATGCCGATAGCGTGAAAGGTCGTTT TACCATTAGCCGTGATAACAGCAAAAACACCGTTTATCTGCAGATG AATAGCCTGCGTCCTGAAGATACCGCAGTTTATTATTGTGCAGCAG ATACCCCTCCGTGGGGTCCGCTGATTTATATTGAAAGCTATGATAG CTGGGGTCAGGGGACCCTGGTCACGGTCTCCTCAGGAGGTGGCGG ATCCGGCGGAGGTAGTGAGGTGCAGCTGGTGGAGTCTGGGGGTGG CTTGGTGCAACCGGGTAACAGTCTGCGCCTTAGCTGCGCAGCGTCT GGCTTTACCTTCAGCTCCTTTGGCATGAGCTGGGTTCGCCAGGCTC CGGGAAAAGGACTGGAATGGGTTTCGTCTATTAGCGGCAGTGGTA GCGATACGCTCTACGCGGACTCCGTGAAGGGCCGTTTCACCATCTC CCGCGATAACGCCAAAACTACACTGTATCTGCAAATGAATAGCCT |

Figure 1 (Continued):

| | | |
|---|---|---|
| | | GCGTCCTGAAGACACGGCCGTTTATTACTGTACTATTGGTGGCTCG TTAAGCCGTTCTTCACAGGGGACCCTGGTCACGGTCTCCTCAGGAG GTGGCGGGTCCGGAGGAGGTAGTGAGGTGCAGCTGGTGGAGTCTG GGGGTGGTCTGGTTCAGCCTGGTGGTAGCCTGCGTCTGAGCTGTGC AGCAAGCGGCACCCTGTTTAAAATTAATGCAATGGGTTGGTATCGC CAGGCACCGGGTAAACGTCGTGAACTGGTTGCACTGATTACCAGC AGCGATACCACCGATTATGCAGAAGATGTTAAAGGTCGCTTTACCA TTAGCCGTGATAATAGCTGGAATACCGTTTATCTGCAGATGAATAG CCTGCGTCCTGAAGATACCGCAGTTTATTATTGTCACAGCGATCAT TATAGCCTGGGTGTGCCGGAAAAACGTGTTATTCTGTATGGTCAGG GGACCCTGGTCACCGTCTCCTCA |
| HER3 MS002 11 | 435 | ATGAAAAAGACCGCTATCGCGATTGCAGTGGCACTGGCTGGTTTG GCCACCGTGGCCCAGGCCGAGGTGCAATTGGTGGAGTCTGGGGGT GGTCTGGTTCAGCCTGGTGGTAGCCTGCGTCTGAGCTGTGCAGCAA GCGGCACCCTGTTTAAAATTAATGCAATGGGTTGGTATCGCCAGGC ACCGGGTAAACGTCGTGAACTGGTTGCACTGATTACCAGCAGCGA TACCACCGATTATGCAGATAGCGTTAAAGGTCGCTTTACCATTAGC CGTGATAATAGCTGGAATACCGTTTATCTGCAGATGAATAGCCTGC GTCCTGAAGATACCGCAGTTTATTATTGTCACAGCGATCATTATAG CCTGGGTGTGCCGGAAAAACGTGTTATTCTGTATGGTCAGGGGACC CTGGTCACCGTCTCCTCAGCGGCCGCAGAACAAAAACTCATCTCAG AAGAGGATCTGAATGGGGCCGCACATCATCATCATCATCAT |
| HER3 MS002 12 | 436 | ATGAGATTTCCTTCAATTTTTACTGCTGTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGACGTGCAATTGGTGGAGTC TGGGGGTGGTCTGGTTCAGCCTGGTGGTAGCCTGCGTCTGAGCTGT GCAGCAAGCGGTAGCATTGGTGGTCTGAATGCAATGGCATGGTAT CGTCAGGCACCGGGTAAAGAACGTGAACTGGTTGCAGGTATTTTTG GTGTTGGTAGCACCCGTTATGCAGATAGCGTTAAAGGTCGTTTTAC CATTAGCCGTGACAATAGCAAAAACACCGTTTATCTGCAGATGAAT AGCCTGCGTCCTGAAGATACCGCAGTTTATTATTGTCGCATGAGCA GCGTTACCCGTGGTAGCAGCGATTATTGGGGTCAGGGGACCCTGGT CACGGTCTCCTCAGGAGGTGGCGGATCCGGCGGAGGTAGTGAGGT GCAGCTGGTGGAGTCTGGGGGTGGCTTGGTGCAACCGGGTAACAG TCTGCGCCTTAGCTGCGCAGCGTCTGGCTTTACCTTCAGCTCCTTTG GCATGAGCTGGGTTCGCCAGGCTCCGGGAAAAGGACTGGAATGGG TTTCGTCTATTAGCGGCAGTGGTAGCGATACGCTCTACGCGGACTC CGTGAAGGGCCGTTTCACCATCTCCCGCGATAACGCCAAAACTACA CTGTATCTGCAAATGAATAGCCTGCGTCCTGAAGACACGGCCGTTT ATTACTGTACTATTGGTGGCTCGTTAAGCCGTTCTTCACAGGGGAC CCTGGTCACGGTCTCCTCAGGAGGTGGCGGGTCCGGAGGAGGTAG TGAGGTGCAGCTGGTGGAGTCTGGGGGTGGTCTGGTTCAGCCTGGT GGTAGCCTGCGTCTGAGCTGTGCAGCAAGCGGCACCCTGTTTAAAA |

Figure 1 (Continued):

| | | |
|---|---|---|
| | | TTAATGCAATGGGTTGGTATCGCCAGGCACCGGGTAAACGTCGTG AACTGGTTGCACTGATTACCAGCAGCGATACCACCGATTATGCAGA TAGCGTTAAAGGTCGCTTTACCATTAGCCGTGATAATAGCTGGAAT ACCGTTTATCTGCAGATGAATAGCCTGCGTCCTGAAGATACCGCAG TTTATTATTGTCACAGCGATCATTATAGCCTGGGTGTGCCGGAAAA ACGTGTTATTCTGTATGGTCAGGGGACCCTGGTCACCGTCTCCTCA |
| HER3 MS002 13 | 437 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGTTTTACCTTTAGCAGCTATCCGATGAGCTGGGTTC GTCAGGCACCGGGTAAAGGTCCTGAATGGGTTAGCACCGTTAGTC CGGGTGGAATTACCACCAGTTATGCAGATAGCGTTAAAGGTCGTTT TACCATTAGCCGTGATAATAGCAAAAATACCCTGTATCTGCAGATG AATAGCCTGCGTCCTGAAGATACCGCAGTTTATTATTGTCTGCGTG ATCTGGGTAATCGTGGTCAGGGGACCCTGGTCACGGTCTCCTCAGG AGGTGGCGGATCCGGCGGAGGTAGTGAGGTGCAGCTGGTGGAGTC TGGGGGTGGCTTGGTGCAACCGGGTAACAGTCTGCGCCTTAGCTGC GCAGCGTCTGGCTTTACCTTCAGCTCCTTTGGCATGAGCTGGGTTC GCCAGGCTCCGGGAAAAGGACTGGAATGGGTTTCGTCTATTAGCG GCAGTGGTAGCGATACGCTCTACGCGGACTCCGTGAAGGGCCGTTT CACCATCTCCCGCGATAACGCCAAAACTACACTGTATCTGCAAATG AATAGCCTGCGTCCTGAAGACACGGCCGTTTATTACTGTACTATTG GTGGCTCGTTAAGCCGTTCTTCACAGGGGACCCTGGTCACGGTCTC CTCAGGAGGTGGCGGGTCCGGAGGAGGTAGTGAGGTGCAGCTGGT GGAGTCTGGGGGTGGTCTGGTTCAGCCTGGTGGTAGCCTGCGTCTG AGCTGTGCAGCAAGCGGCACCCTGTTTAAAATTAATGCAATGGGTT GGTATCGCCAGGCACCGGGTAAACGTCGTGAACTGGTTGCACTGA TTACCAGCAGCGATACCACCGATTATGCAGATAGCGTTAAAGGTC GCTTTACCATTAGCCGTGATAATAGCTGGAATACCGTTTATCTGCA GATGAATAGCCTGCGTCCTGAAGATACCGCAGTTTATTATTGTCAC AGCGATCATTATAGCCTGGGTGTGCCGGAAAAACGTGTTATTCTGT ATGGTCAGGGGACCCTGGTCACCGTCTCCTCA |
| HER3 MS002 14 | 438 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGTCGTACCTATTATCTGAATGCAATGGGTTGGTTTC GTCAGGCACCGGGTAAAGAACGTGAATTTGTTGCAGCCATTGATTG GAGCGAAGGCAATAAAGATTATGCCGATAGCGTGAAAGGTCGTTT |

Figure 1 (Continued):

| | | |
|---|---|---|
| | | TACCATTAGCCGTGATAACAGCAAAAACACCGTTTATCTGCAGATG AATAGCCTGCGTCCTGAAGATACCGCAGTTTATTATTGTGCAGCAG ATACCCCTCCGTGGGGTCCGCTGATTTATATTGAAAGCTATGATAG CTGGGGTCAGGGGACCCTGGTCACGGTCTCCTCAGGAGGTGGCGG ATCCGGCGGAGGTAGTGAGGTGCAGCTGGTGGAGTCTGGGGGTGG CTTGGTGCAACCGGGTAACAGTCTGCGCCTTAGCTGCGCAGCGTCT GGCTTTACCTTCAGCTCCTTTGGCATGAGCTGGGTTCGCCAGGCTC CGGGAAAAGGACTGGAATGGGTTTCGTCTATTAGCGGCAGTGGTA GCGATACGCTCTACGCGGACTCCGTGAAGGGCCGTTTCACCATCTC CCGCGATAACGCCAAAACTACACTGTATCTGCAAATGAATAGCCT GCGTCCTGAAGACACGGCCGTTTATTACTGTACTATTGGTGGCTCG TTAAGCCGTTCTTCACAGGGGACCCTGGTCACGGTCTCCTCAGGAG GTGGCGGGTCCGGAGGAGGTAGTGAGGTGCAGCTGGTGGAGTCTG GGGGTGGTCTGGTTCAGCCTGGTGGTAGCCTGCGTCTGAGCTGTGC AGCAAGCGGCACCCTGTTTAAAATTAATGCAATGGGTTGGTATCGC CAGGCACCGGGTAAACGTCGTGAACTGGTTGCACTGATTACCAGC AGCGATACCACCGATTATGCAGATAGCGTTAAAGGTCGCTTTACCA TTAGCCGTGATAATAGCTGGAATACCGTTTATCTGCAGATGAATAG CCTGCGTCCTGAAGATACCGCAGTTTATTATTGTCACAGCGATCAT TATAGCCTGGGTGTGCCGGAAAAACGTGTTATTCTGTATGGTCAGG GGACCCTGGTCACCGTCTCCTCA |
| HER3 MS002 15 | 439 | ATGAGATTTCCTTCAATTTTTACTGCTGTTTTATTCGCAGCATCCTC CGCATTAGCTGCTCCAGTCAACACTACAACAGAAGATGAAACGGC ACAAATTCCGGCTGAAGCTGTCATCGGTTACTCAGATTTAGAAGGG GATTTCGATGTTGCTGTTTTGCCATTTTCCAACAGCACAAATAACG GGTTATTGTTTATAAATACTACTATTGCCAGCATTGCTGCTAAAGA AGAAGGGGTATCTCTCGAAAAGAGAGAGGTGCAATTGGTGGAGTC TGGGGGTGGTCTGGTTCAGCCTGGTGGTAGCCTGCGTCTGAGCTGT GCAGCAAGCGGCACCCTGTTTAAAATTAATGCAATGGGTTGGTATC GCCAGGCACCGGGTAAACGTCGTGAACTGGTTGCACTGATTACCA GCAGCGATACCACCGATTATGCAGATAGCGTTAAAGGTCGCTTTAC CATTAGCCGTGATAATAGCTGGAATACCGTTTATCTGCAGATGAAT AGCCTGCGTCCTGAAGATACCGCAGTTTATTATTGTCACAGCGATC ATTATAGCCTGGGTGTGCCGGAAAAACGTGTTATTCTGTATGGTCA GGGGACCCTGGTCACGGTCTCCTCAGGAGGTGGCGGATCCGGCGG AGGTAGTGAGGTGCAGCTGGTGGAGTCTGGGGGTGGCTTGGTGCA ACCGGGTAACAGTCTGCGCCTTAGCTGCGCAGCGTCTGGCTTTACC TTCAGCTCCTTTGGCATGAGCTGGGTTCGCCAGGCTCCGGGAAAAG GACTGGAATGGGTTTCGTCTATTAGCGGCAGTGGTAGCGATACGCT CTACGCGGACTCCGTGAAGGGCCGTTTCACCATCTCCCGCGATAAC GCCAAAACTACACTGTATCTGCAAATGAATAGCCTGCGTCCTGAAG ACACGGCCGTTTATTACTGTACTATTGGTGGCTCGTTAAGCCGTTCT TCACAGGGGACCCTGGTCACGGTCTCCTCAGGAGGTGGCGGGTCC GGAGGAGGTAGTGAGGTGCAGCTGGTGGAGTCTGGGGGTGGTCTG GTTCAGCCTGGTGGTAGCCTGCGTCTGAGCTGTGCAGCAAGCGGTA GCATTGGTGGTCTGAATGCAATGGCATGGTATCGTCAGGCACCGG |

Figure 1 (Continued):

| | | |
|---|---|---|
| | | GTAAAGAACGTGAACTGGTTGCAGGTATTTTTGGTGTTGGTAGCAC CCGTTATGCAGATAGCGTTAAAGGTCGTTTTACCATTAGCCGTGAC AATAGCAAAAACACCGTTTATCTGCAGATGAATAGCCTGCGTCCTG AAGATACCGCAGTTTATTATTGTCGCATGAGCAGCGTTACCCGTGG TAGCAGCGATTATTGGGGTCAGGGGACCCTGGTCACCGTCTCCTCA |
| HER3 MS004 C07 | 440 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGGCTGGGGGGTCTCTGAGACTCTCCTGTGCAGCCT CTGGATTCACCTTCAGTAGCTATCCCATGAGCTGGGTCCGCCAGGC TCCAGGAAAGGGGCCCGCGTGGGTCTCAACTGTTAGTCCTGGTGGT ATAACCACAAGCTATGCAGACTCCGTGAAGGGCCGATTCACCATCT CCAGAGACAACGCCAAGAACACGCTGTATTTGCAAATGAACAGCC TGAAACCTGAGGACACGGCCGTGTATTACTGCTTAAGAGATCTGA ATAATAGGGGCCAGGGGACCCAGGTCACCGTCTCCTCAGCGGCCG CAGAACAAAAACTCATCTCAGAAGAGGATCTGAATGGGGCCGCAC ATCATCATCATCAT |
| HER3 MS017 B05 | 441 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAACCTGGGGGGTCTCTGAGACTCTCCTGCGCAGCCT CTGGAAGCATCGGCGGTCTCAATGCCATGGCCTGGTACCGCCAGG CTCCAGGAAAAGAGCGCGAGTTGGTCGCAGGTATTTTTGGCGTTGG TAGCACGAGGTACGCGGACTCCGTGAAGGGCCGATTCACCATCTCT AGAGACATCGCCAAGAACACGGTGTTTCTGCAAATGAACAGCCTG AATTCTGAGGACACGGCCGTTTATTACTGTCGGATGTCAAGTGTTA CTCGTGGTAGTTCTGACTACTGGGGTCAGGGGACCCAGGTCACCGT CTCCTCAGCGGCCGCAGAACAAAAACTCATCTCAGAAGAGGATCT GAATGGGGCCGCACATCATCATCATCAT |
| HER3 MS018 G11 | 442 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGAGACTCTCCTGTGCAGCCT CTGGAACGCTCTTCAAAATCAACGCCATGGGCTGGTACCGCCAGG CTCCAGGGAAGCGGCGCGAGTTGGTCGCACTTATTACTAGTAGCG ATACAACGGATTATGCAGAGTCCGTGGAGGGCCGATTCACCATCTC CAGAGACAACACGTGGAACGCGGTGTATCTGCAAATGAACAGTCT GAAACCTGAGGATACGGCCGTCTATTACTGTCACTCAGATCATTAC TCGATGGGTGTGCCTGAAAAGCGAGTCATAATGTACGGCCAGGGG ACCCAGGTCACCGTCTCCTCAGCGGCCGCAGAACAAAAACTCATCT CAGAAGAGGATCTGAATGGGGCCGCACATCATCATCATCATCAT |
| HER3 MS021 F06 | 443 | ATGAAAAAGACCGCTATCGCGATTGCAGTGGCACTGGCTGGTTTG GCCACCGTGGCCCAGGCCGAGGTGCAATTGGTGGAGTCTGGGGGA GGATTGGTGCAGGCTGGGGGCTCTCTGAGACTCTCCTGTGCAGCCT CTGGACGCACGTACTATCTCAATGCCATGGGCTGGTTCCGCCAGGG TCCAGGGAAGGACCGTGAGTTTGTAGCAGCTATAGACTGGAGTGA TGGTAACAAAGACTATGCAGACTCCGTGAAGGGCCGATTCACCAT CTCCAGAGACAACGCCAAGAACACGGTGTATCTGCAAATGAACAG CCTGAAACCTGAGGACACGGCCGTTTATTACTGTGCAGCCGACACA |

Figure 1 (Continued):

| | | |
|---|---|---|
| | | CCACCCTGGGGGCCTATGATCTACATCGAATCGTATGACTCCTGGG GCCAGGGGACCCAGGTCACCGTCTCCTCAGCGGCCGCAGAACAAA AACTCATCTCAGAAGAGGATCTGAATGGGGCCGCACATCATCATC ATCATCAT |
| HER3 MS034 C07 | 444 | ATGAAAAAGACCGCTATCGCGATTGCAGTGGCACTGGCTGGTTTG GCCACCGTGGCCCAGGCCGAGGTGCAATTGGTGGAGTCTGGGGGA GGCTTGGTGCAGCCTGGGGGGTCTCTGGGACTCTCCTGTGTAGCCT CTGGAAGCATCTTCAGAATCAATGCCATGGCCTGGTACCGCCAGGC TCCAGGGAAGCAGCGCGAGTTGGTCGCGGAAATTACTGCTGGTGG TAGCACAAACTATGCAGACTCCGTGAAGGGCCGATTCACCATCTCC GTAGACAACGCCTGGAACACGCTGTATCTGCAAATGAACAGCCTG AAAGTTGAGGACACGGCCGTCTATTACTGTAATCTAGATCATTATA CGACATGGGATAGACGGAGTGCCTACTGGGGCCAGGGGACCCAGG TCACCGTCTCCTCAGCGGCCGCAGAACAAAAACTCATCTCAGAAG AGGATCTGAATGGGGCCGCACATCATCATCATCATCAT |

Figure 4:

| Name | SEQ ID NO: X, wherein X= | Amino acid sequence |
|---|---|---|
| hHER3 or human HER3 or Accession No. In GenBank M34309 | 1 | MRANDALQVLGLLFSLARGSEVGNSQAVCPGTLNGLSVT GDAENQYQTLYKLYERCEVVMGNLEIVLTGHNADLSFLQ WIREVTGYVLVAMNEFSTLPLPNLRVVRGTQVYDGKFAIF VMLNYNTNSSHALRQLRLTQLTEILSGGVYIEKNDKLCHM DTIDWRDIVRDRDAEIVVKDNGRSCPPCHEVCKGRCWGP GSEDCQTLTKTICAPQCNGHCFGPNPNQCCHDECAGGCSG PQDTDCFACRHFNDSGACVPRCPQPLVYNKLTFQLEPNPH TKYQYGGVCVASCPHNFVVDQTSCVRACPPDKMEVDKN GLKMCEPCGGLCPKACEGTGSGSRFQTVDSSNIDGFVNCT KILGNLDFLITGLNGDPWHKIPALDPEKLNVFRTVREITGY LNIQSWPPHMHNFSVFSNLTTIGGRSLYNRGFSLLIMKNLN VTSLGFRSLKEISAGRIYISANRQLCYHHSLNWTKVLRGPT EERLDIKHNRPRRDCVAEGKVCDPLCSSGGCWGPGPGQCL SCRNYSRGGVCVTHCNFLNGEPREFAHEAECFSCHPECQP MEGTATCNGSGSDTCAQCAHFRDGPHCVSSCPHGVLGAK GPIYKYPDVQNECRPCHENCTQGCKGPELQDCLGQTLVLI GKTHLTMALTVIAGLVVIFMMLGGTFLYWRGRRIQNKRA MRRYLERGESIEPLDPSEKANKVLARIFKETELRKLKVLGS GVFGTVHKGVWIPEGESIKIPVCIKVIEDKSGRQSFQAVTD HMLAIGSLDHAHIVRLLGLCPGSSLQLVTQYLPLGSLLDHV RQHRGALGPQLLLNWGVQIAKGMYYLEEHGMVHRNLAA RNVLLKSPSQVQVADFGVADLLPPDDKQLLYSEAKTPIKW MALESIHFGKYTHQSDVWSYGVTVWELMTFGAEPYAGLR LAEVPDLLEKGERLAQPQICTIDVYMVMVKCWMIDENIRP TFKELANEFTRMARDPPRYLVIKRESGPGIAPGPEPHGLTN |

Figure 4 (Continued):

| | | |
|---|---|---|
| | | KKLEEVELEPELDLDLDLEAEEDNLATTTLGSALSLPVGTL NRPRGSQSLLSPSSGYMPMNQGNLGESCQESAVSGSSERC PRPVSLHPMRGCLASESSEGHVTGSEAELQEKVSMCRSR SRSRSPRPRGDSAYHSQRHSLLTPVTPLSPPGLEEEDVNGY VMPDTHLKGTPSSREGTLSSVGLSSVLGTEEEDEDEEYEY MNRRRRHSPPHPPRPSSLEELGYEYMDVGSDLSASLGSTQ SCPLHPVPIMPTAGTTPDEDYEYMNRQRDGGGPGGDYAA MGACPASEQGYEEMRAFQGPGHQAPHVHYARLKTLRSLE ATDSAFDNPDYWHSRLFPKANAQRT |
| chHER3 or chicken HER3 | 2 | MRANDALQVLGLLFSLARGSEVGNSQAVCAGTLNGLSVT GDAQHQYRTLHKMYNNCEIVMGNLEIVLIDHTQDLSFLQT IREVTGYILIAMNVFSTLPLRNLRVIRGTQFYEEKYALFVLL NYNPNATHALRQLGLNRLTEILAGGVYIEKNEQLCHVDTV EWRDIMRDPRLEPVVGDNGRACAPCHESCGGHCWGPGPE DCQQLTKTICAPQCNGRCFGRAPNECCHEECAGGCTGPLQ THCFACRHFNDSGACVPLCPQPLIYNKLTFQLEPNPDTKYQ YGSVCVRSCPHNFVVDQSSCVRACPSNKMEVEKNGLKMC EPCAGLCPKACEGTGAGSHYQTVDSSNIDSFVNCTKILGNL DFLITGLEGDPWRNISALDPEKLNVFRTVREITGYLNIQSW PKHMHNFSVFSNLETIGGRSLYNRGFSLLIMKNDNVTSLGL RSLREVSAGRVYITENRRLCYLHTVQWAALSRRRADLDIR NNKPRGKCQQEGKVCDPLCSADGCWGPGPAQCLSCRHYS RRGVCVESCSFTQGETREFAEGTECFECHPECERVEGGITC NGSGADTCTRCAHYRDGPHCVERCPEGILGERGPIYKYPD SSRECRPCHENCTRGCTGPLLQDCLGDALPSARRAPTVI |
| cHER3 ECD or cyno HER3 extracellular domain | 3 | MRANGALQVLGLLFNLARGSEVGNSQAVCPGTLNGLSVT GDAENQYQTLYKLYERCEVVMGNLEIVLTGHNADLSFLQ WIREVTGYVLVAMNEFSTLPLPNLRVVRGTQVYDGKFAIF VMLNYNTNSSHALRQLRLTQLTEILSGGVYIEKNDKLCHM DTIDWKDIVRDQDAEIVVKDNGRSCPLCHEVCKGRCWGP |

Figure 4 (Continued):

| | | |
|---|---|---|
| | | GPEDCQTLTKTICAPQCNGHCFGPNPNQCCHDECAGGCSG PQDTDCFACRHFNDSGACVPRCPQPLVYNKLTFQLEPNPH TKYQYGGVCVASCPHNFVVDQTSCVRACPPDKMEVDKN GLKMCEPCGGLCPKACEGTGSGSRFQTVDSSNIDGFVNCT KILGNLDFLITGLNGDPWHKIPALDPEKLNVFRTVREITGY LNIQSWPPHMYNFSVFSNLTTIGGRSLYNRGFSLLIMKNLN VTSLGFRSLKEISAGRIYISANRQLCYHHSLNWTKVLRGPT EERLDIKHNRPRRDCVAEGKVCDPLCSSGGCWGPGPGQCL SCRNYSRGGVCVTHCNFLNGEPREFAHEAECFSCHPECQP MEGTATCNGSGSDTCAQCAHFRDGPHCVSSCPHGVLGAK GPIYKYPDVQNECRPCHENCTQGCKGPELQDCLGQTLVLI GKTHLTHHHHHH |
| hHER3 ECD or human HER3 extracellular domain | 4 | MRANDALQVLGLLFSLARGSEVGNSQAVCPGTLNGLSVT GDAENQYQTLYKLYERCEVVMGNLEIVLTGHNADLSFLQ WIREVTGYVLVAMNEFSTLPLPNLRVVRGTQVYDGKFAIF VMLNYNTNSSHALRQLRLTQLTEILSGGVYIEKNDKLCHM DTIDWRDIVRDRDAEIVVKDNGRSCPPCHEVCKGRCWGP GSEDCQTLTKTICAPQCNGHCFGPNPNQCCHDECAGGCSG PQDTDCFACRHFNDSGACVPRCPQPLVYNKLTFQLEPNPH TKYQYGGVCVASCPHNFVVDQTSCVRACPPDKMEVDKN GLKMCEPCGGLCPKACEGTGSGSRFQTVDSSNIDGFVNCT KILGNLDFLITGLNGDPWHKIPALDPEKLNVFRTVREITGY LNIQSWPPHMHNFSVFSNLTTIGGRSLYNRGFSLLIMKNLN VTSLGFRSLKEISAGRIYISANRQLCYHHSLNWTKVLRGPT EERLDIKHNRPRRDCVAEGKVCDPLCSSGGCWGPGPGQCL SCRNYSRGGVCVTHCNFLNGEPREFAHEAECFSCHPECQP MEGTATCNGSGSDTCAQCAHFRDGPHCVSSCPHGVLGAK GPIYKYPDVQNECRPCHENCTQGCKGPELQDCLGQTLVLI GKTHLTHHHHHH |
| chimeric | 5 | MRANDALQVLGLLFSLARGSEVGNSQAVCPGTLNGLSVT |

Figure 4 (Continued):

| | | |
|---|---|---|
| chicken Her3 – human domain 1 | | GDAENQYQTLYKLYERCEVVMGNLEIVLTGHNADLSFLQ WIREVTGYVLVAMNEFSTLPLPNLRVVRGTQVYDGKFAIF VMLNYNTNSSHALRQLRLTQLTEILSGGVYIEKNDKLCHM DTIDWRDIVRDRDAEIVVKDNGRSCPPCHEVCKGRCWGP GSEDCQTLTKTICAPQCNGRCFGRAPNECCHEECAGGCTG PLQTHCFACRHFNDSGACVPLCPQPLIYNKLTFQLEPNPDT KYQYGSVCVRSCPHNFVVDQSSCVRACPSNKMEVEKNGL KMCEPCAGLCPKACEGTGAGSHYQTVDSSNIDSFVNCTKI LGNLDFLITGLEGDPWRNISALDPEKLNVFRTVREITGYLNI QSWPKHMHNFSVFSNLETIGGRSLYNRGFSLLIMKNDNVT SLGLRSLREVSAGRVYITENRRLCYLHTVQWAALSRRRAD LDIRNNKPRGKCQQEGKVCDPLCSADGCWGPGPAQCLSC RHYSRRGVCVESCSFTQGETREFAEGTECFECHPECERVEG GITCNGSGADTCTRCAHYRDGPHCVERCPEGILGERGPIYK YPDSSRECRPCHENCTRGCTGPLLQDCLGDALPSARRAPT VI |
| chimeric chicken Her3 – human domain 2 | 6 | MRANDALQVLGLLFSLARGSEVGNSQAVCAGTLNGLSVT GDAQHQYRTLHKMYNNCEIVMGNLEIVLIDHTQDLSFLQT IREVTGYILIAMNVFSTLPLRNLRVIRGTQFYEEKYALFVLL NYNPNATHALRQLGLNRLTEILAGGVYIEKNEQLCHVDTV EWRDIMRDPRLEPVVGDNGRACAPCHESCGGHCWGPGPE DCQQLTKTICAPQCNGHCFGPNPNQCCHDECAGGCSGPQ DTDCFACRHFNDSGACVPRCPQPLVYNKLTFQLEPNPHTK YQYGGVCVASCPHNFVVDQTSCVRACPPDKMEVDKNGL KMCEPCGGLCPKACEGTGAGSHYQTVDSSNIDSFVNCTKI LGNLDFLITGLEGDPWRNISALDPEKLNVFRTVREITGYLNI QSWPKHMHNFSVFSNLETIGGRSLYNRGFSLLIMKNDNVT SLGLRSLREVSAGRVYITENRRLCYLHTVQWAALSRRRAD LDIRNNKPRGKCQQEGKVCDPLCSADGCWGPGPAQCLSC RHYSRRGVCVESCSFTQGETREFAEGTECFECHPECERVEG |

Figure 4 (Continued):

| | | |
|---|---|---|
| | | GITCNGSGADTCTRCAHYRDGPHCVERCPEGILGERGPIYK YPDSSRECRPCHENCTRGCTGPLLQDCLGDALPSARRAPT VI |
| chimeric chicken Her3 – human domain 4 | 7 | MRANDALQVLGLLFSLARGSEVGNSQAVCAGTLNGLSVT GDAQHQYRTLHKMYNNCEIVMGNLEIVLIDHTQDLSFLQT IREVTGYILIAMNVFSTLPLRNLRVIRGTQFYEEKYALFVLL NYNPNATHALRQLGLNRLTEILAGGVYIEKNEQLCHVDTV EWRDIMRDPRLEPVVGDNGRACAPCHESCGGHCWGPGPE DCQQLTKTICAPQCNGRCFGRAPNECCHEECAGGCTGPLQ THCFACRHFNDSGACVPLCPQPLIYNKLTFQLEPNPDTKYQ YGSVCVRSCPHNFVVDQSSCVRACPSNKMEVEKNGLKMC EPCAGLCPKACEGTGAGSHYQTVDSSNIDSFVNCTKILGNL DFLITGLEGDPWRNISALDPEKLNVFRTVREITGYLNIQSW PKHMHNFSVFSNLETIGGRSLYNRGFSLLIMKNDNVTSLGL RSLREVSAGRVYITENRRLCYLHTVQWAALSRRRADLDIR NNKPRGKCQQEGKVCDPLCSSGGCWGPGPGQCLSCRNYS RGGVCVTHCNFLNGEPREFAHEAECFSCHPECQPMEGTAT CNGSGSDTCAQCAHFRDGPHCVSSCPHGVLGAKGPIYKYP DVQNECRPCHENCTQGCKGPELQDCLGQTLVLIGKTHLT M |
| Human EGFR, Human HER1 | 8 | MRPSGTAGAALLALLAALCPASRALEEKKVCQGTSNKLT QLGTFEDHFLSLQRMFNNCEVVLGNLEITYVQRNYDLSFL KTIQEVAGYVLIALNTVERIPLENLQIIRGNMYYENSYALA VLSNYDANKTGLKELPMRNLQEILHGAVRFSNNPALCNVE SIQWRDIVSSDFLSNMSMDFQNHLGSCQKCDPSCPNGSCW GAGEENCQKLTKIICAQQCSGRCRGKSPSDCCHNQCAAGC TGPRESDCLVCRKFRDEATCKDTCPPLMLYNPTTYQMDV NPEGKYSFGATCVKKCPRNYVVTDHGSCVRACGADSYEM EEDGVRKCKKCEGPCRKVCNGIGIGEFKDSLSINATNIKHF KNCTSISGDLHILPVAFRGDSFTHTPPLDPQELDILKTVKEIT |

Figure 4 (Continued):

| | | |
|---|---|---|
| | | GFLLIQAWPENRTDLHAFENLEIIRGRTKQHGQFSLAVVSL NITSLGLRSLKEISDGDVIISGNKNLCYANTINWKKLFGTSG QKTKIISNRGENSCKATGQVCHALCSPEGCWGPEPRDCVS CRNVSRGRECVDKCKLLEGEPREFVENSECIQCHPECLPQA MNITCTGRGPDNCIQCAHYIDGPHCVKTCPAGVMGENNTL VWKYADAGHVCHLCHPNCTYGCTGPGLEGCPTNGPKIPSI ATGMVGALLLLLVVALGIGLFMRRRHIVRKRTLRRLLQER ELVEPLTPSGEAPNQALLRILKETEFKKIKVLGSGAFGTVY KGLWIPEGEKVKIPVAIKELREATSPKANKEILDEAYVMAS VDNPHVCRLLGICLTSTVQLITQLMPFGCLLDYVREHKDNI GSQYLLNWCVQIAKGMNYLEDRRLVHRDLAARNVLVKT PQHVKITDFGLAKLLGAEEKEYHAEGGKVPIKWMALESIL HRIYTHQSDVWSYGVTVWELMTFGSKPYDGIPASEISSILE KGERLPQPPICTIDVYMIMVKCWMIDADSRPKFRELIIEFSK MARDPQRYLVIQGDERMHLPSPTDSNFYRALMDEEDMDD VVDADEYLIPQQGFFSSPSTSRTPLLSSLSATSNNSTVACID RNGLQSCPIKEDSFLQRYSSDPTGALTEDSIDDTFLPVPEYI NQSVPKRPAGSVQNPVYHNQPLNPAPSRDPHYQDPHSTAV GNPEYLNTVQPTCVNSTFDSPAHWAQKGSHQISLDNPDYQ QDFFPKEAKPNGIFKGSTAENAEYLRVAPQSSEFIGA |
| hHER2 or Human HER2 | 9 | MELAALCRWGLLLALLPPGAASTQVCTGTDMKLRLPASP ETHLDMLRHLYQGCQVVQGNLELTYLPTNASLSFLQDIQE VQGYVLIAHNQVRQVPLQRLRIVRGTQLFEDNYALAVLD NGDPLNNTTPVTGASPGGLRELQLRSLTEILKGGVLIQRNP QLCYQDTILWKDIFHKNNQLALTLIDTNRSRACHPCSPMC KGSRCWGESSEDCQSLTRTVCAGGCARCKGPLPTDCCHE QCAAGCTGPKHSDCLACLHFNHSGICELHCPALVTYNTDT FESMPNPEGRYTFGASCVTACPYNYLSTDVGSCTLVCPLH NQEVTAEDGTQRCEKCSKPCARVCYGLGMEHLREVRAVT SANIQEFAGCKKIFGSLAFLPESFDGDPASNTAPLQPEQLQ |

Figure 4 (Continued):

|  |  |  |
|---|---|---|
|  |  | VFETLEEITGYLYISAWPDSLPDLSVFQNLQVIRGRILHNGA YSLTLQGLGISWLGLRSLRELGSGLALIHHNTHLCFVHTVP WDQLFRNPHQALLHTANRPEDECVGEGLACHQLCARGHC WGPGPTQCVNCSQFLRGQECVEECRVLQGLPREYVNARH CLPCHPECQPQNGSVTCFGPEADQCVACAHYKDPPFCVAR CPSGVKPDLSYMPIWKFPDEEGACQPCPINCTHSCVDLDD KGCPAEQRASPLTSIISAVVGILLVVVLGVVFGILIKRRQQK IRKYTMRRLLQETELVEPLTPSGAMPNQAQMRILKETELR KVKVLGSGAFGTVYKGIWIPDGENVKIPVAIKVLRENTSPK ANKEILDEAYVMAGVGSPYVSRLLGICLTSTVQLVTQLMP YGCLLDHVRENRGRLGSQDLLNWCMQIAKGMSYLEDVR LVHRDLAARNVLVKSPNHVKITDFGLARLLDIDETEYHAD GGKVPIKWMALESILRRRFTHQSDVWSYGVTVWELMTFG AKPYDGIPAREIPDLLEKGERLPQPPICTIDVYMIMVKCWM IDSECRPRFRELVSEFSRMARDPQRFVVIQNEDLGPASPLDS TFYRSLLEDDDMGDLVDAEEYLVPQQGFFCPDPAPGAGG MVHHRHRSSSTRSGGGDLTLGLEPSEEEAPRSPLAPSEGAG SDVFDGDLGMGAAKGLQSLPTHDPSPLQRYSEDPTVPLPS ETDGYVAPLTCSPQPEYVNQPDVRPQPPSPREGPLPAARPA GATLERAKTLSPGKNGVVKDVFAFGGAVENPEYLTPQGG AAPQPHPPPAFSPAFDNLYYWDQDPPERGAPPSTFKGTPTA ENPEYLGLDVPV |
| hHER4 or human HER4 | 10 | MKPATGLWVWVSLLVAAGTVQPSDSQSVCAGTENKLSSL SDLEQQYRALRKYYENCEVVMGNLEITSIEHNRDLSFLRS VREVTGYVLVALNQFRYLPLENLRIIRGTKLYEDRYALAIF LNYRKDGNFGLQELGLKNLTEILNGGVYVDQNKFLCYAD TIHWQDIVRNPWPSNLTLVSTNGSSGCGRCHKSCTGRCWG PTENHCQTLTRTVCAEQCDGRCYGPYVSDCCHRECAGGC SGPKDTDCFACMNFNDSGACVTQCPQTFVYNPTTFQLEHN FNAKYTGAFCVKKCPHNFVVDSSSCVRACPSSKMEVEE |

Figure 4 (Continued):

| | | |
|---|---|---|
| | | NGIKMCKPCTDICPKACDGIGTGSLMSAQTVDSSNIDKFIN CTKINGNLIFLVTGIHGDPYNAIEAIDPEKLNVFRTVREITG FLNIQSWPPNMTDFSVFSNLVTIGGRVLYSGLSLLILKQQGI TSLQFQSLKEISAGNIYITDNSNLCYYHTINWTTLFSTINQRI VIRDNRKAENCTAEGMVCNHLCSSDGCWGPGPDQCLSCR RFSRGRICIESCNLYDGEFREFENGSICVECDPQCEKMEDG LLTCHGPGPDNCTKCSHFKDGPNCVEKCPDGLQGANSFIF KYADPDRECHPCHPNCTQGCNGPTSHDCIYYPWTGHSTLP QHARTPLIAAGVIGGLFILVIVGLTFAVYVRRKSIKKKRAL RRFLETELVEPLTPSGTAPNQAQLRILKETELKRVKVLGSG AFGTVYKGIWVPEGETVKIPVAIKILNETTGPKANVEFMDE ALIMASMDHPHLVRLLGVCLSPTIQLVTQLMPHGCLLEYV HEHKDNIGSQLLLNWCVQIAKGMMYLEERRLVHRDLAAR NVLVKSPNHVKITDFGLARLLEGDEKEYNADGGKMPIKW MALECIHYRKFTHQSDVWSYGVTIWELMTFGGKPYDGIPT REIPDLLEKGERLPQPPICTIDVYMVMVKCWMIDADSRPKF KELAAEFSRMARDPQRYLVIQGDDRMKLPSPNDSKFFQNL LDEEDLEDMMDAEEYLVPQAFNIPPPIYTSRARIDSNRSEIG HSPPPAYTPMSGNQFVYRDGGFAAEQGVSVPYRAPTSTIPE APVAQGATAEIFDDSCCNGTLRKPVAPHVQEDSSTQRYSA DPTVFAPERSPRGELDEEGYMTPMRDKPKQEYLNPVEENP FVSRRKNGDLQALDNPEYHNASNGPPKAEDEYVNEPLYL NTFANTLGKAEYLKNNILSMPEKAKKAFDNPDYWNHSLP PRSTLQHPDYLQEYSTKYFYKQNGRIRPIVAENPEYLSEFS LKPGTVLPPPPYRHRNTVV |
| ALB8 | 11 | EVQLVESGGGLVQPGNSLRLSCAASGFTFSSFGMSWVRQA PGKGLEWVSSISGSGSDTLYADSVKGRFTISRDNAKTTLYL QMNSLRPEDTAVYYCTIGGSLSRSSQGTLVTVSS |

Figure 5
A
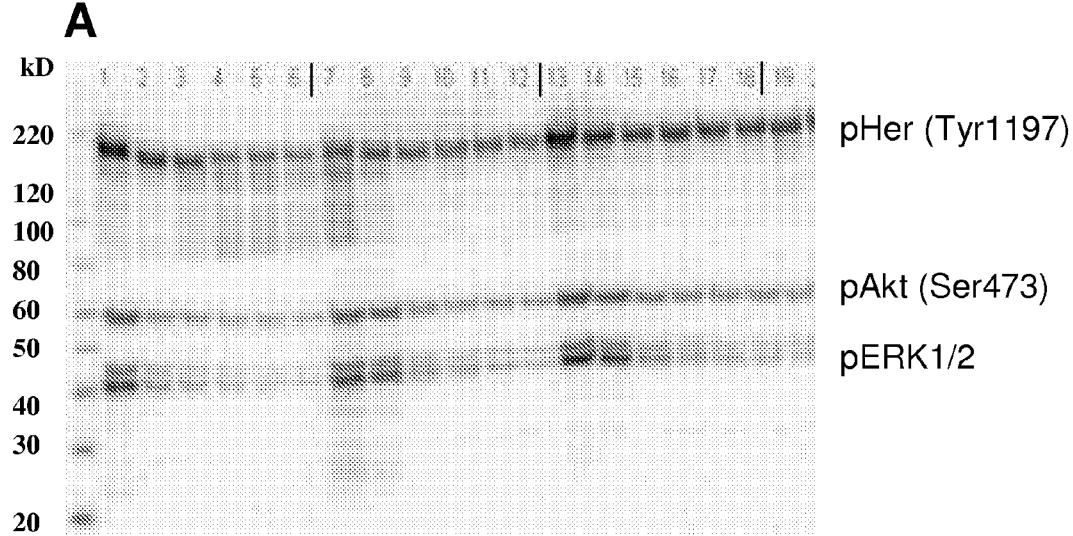
B
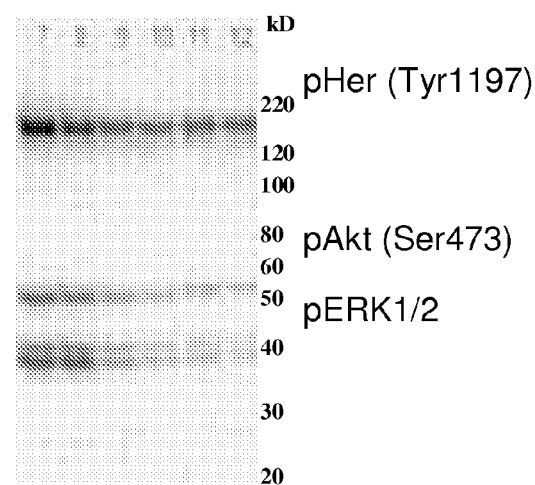

BIOLOGICAL MATERIALS RELATED TO HER3

CROSS-REFERENCE TO RELATED APPLICATION(S)

This application is the National Phase of International Patent Application No. PCT/FP2011/058295, tiled May 20, 2011, published as WO 2011/144749, which claims priority to U.S. Provisional Application No. 61/346,548, filed May 20, 2010. The contents of these applications are herein incorporated by reference in their entirety.

The instant application contains a Sequence Listing which has been submitted electronically in ASCII format and is hereby incorporated by reference in its entirety. Said ASCII copy, created on Feb. 23, 2016, is named 103926-0100_SL.txt and is 840,697 bytes in size.

The present invention relates to amino acid sequences that are directed against (as defined herein) HER3, as well as to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively).

In some specific, but non-limiting aspects (described in more detail herein), the invention provides:
- amino acid sequences that are directed against (as defined herein) HER3 and that are capable of inhibiting or blocking (fully or partially, as further described herein) the binding of HRG to HER3 (as further described herein);
- amino acid sequences that are directed against (as defined herein) HER3 and that are capable of inhibiting or blocking (fully or partially, as further described herein) heterodimerization of HER3 (as further described herein);
- amino acid sequences that are directed against (as defined herein) HER3 and that are capable of binding to domain II of HER3; and/or
- amino acid sequences that are directed against (as defined herein) HER3 and that are capable of inhibiting or blocking (fully or partially, as further described herein) HER3 phosphorylation (as further described herein).

As further described herein, in a specific preferred, but non-limiting aspect, the various amino acid sequences directed against HER3 that are described herein (including those according to specific aspects) are preferably immunoglobulin single variable domains (also referred to herein as "ISV's). An immunoglobulin single variable domain is an amino acid sequence that:
- comprises an immunoglobulin fold or that, under suitable conditions (such as physiological conditions) is capable of forming an immunoglobulin fold (i.e. by folding), i.e. so as to form an immunoglobulin variable domain (such as, for example, a VH, VL or VHH domain); and that
- forms (or under such suitable conditions is capable of forming) an immunoglobulin variable domain that comprises a functional antigen binding activity (in the sense that it does not require an interaction with another immunoglobulin variable domain (such as a VH-VL interaction) to form a functional antigen binding site).

Amino acid sequences of the invention that are ISV's are also referred to herein as "ISV's of the invention". Some preferred examples of immunoglobulin single variable domains suitable for use in the invention will become clear from the further description herein, and for example comprise VHH's and/or (other) Nanobodies (preferred) such as humanized VHH's or camelized VH's such as camelized human VH, dAb's and (single) domain antibodies.

As also further described herein, the various amino acid sequences directed against HER3 that are described herein (including those according to specific aspects) can with advantage be used as building blocks to provide multivalent (as described herein, such as bi- or trivalent), multispecific (as described herein, such as bi- or trispecific) or multiparatopic (as described herein, such as biparatopic) polypeptides of the invention, and such polypeptides of the invention for further preferred but non-limiting aspects of the invention. Again, also in these aspects of the invention, the amino acid sequences of the invention present in such polypeptides are preferably ISV's (and preferably nanobodies as described herein).

For example and without limitation, in one specific aspect of the invention, such a polypeptide may comprise at least one (such as one or two) ISV's (and preferably nanobodies) that are directed against (as defined herein) HER3 and that are capable of inhibiting or blocking (fully or partially, as further described herein) the binding of HRG to HER3 (as further described herein) and at least one (such as one or two) ISV's (and preferably nanobodies) that are directed against (as defined herein) HER3 and that are capable of inhibiting or blocking (fully or partially, as further described herein) heterodimerization of HER3 (as further described herein). These and the other amino acid sequences and polypeptides of the invention may also have been provided with an increased half-life in vivo, as further described herein.

Some preferred but non-limiting examples of the various amino acid sequences and polypeptides of the invention will become clear from the further description herein.

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein.

BACKGROUND OF THE INVENTION

HER3 (human epidermal growth factor receptor 3) belongs to the ErbB/HER subfamily of polypeptide growth factor receptors, which includes the epidermal growth factor (EGF) receptor (EGFR, ErbB1, HER1), the neu oncogene product (ErbB2, HER2), and the more recently identified ErbB3, HER3 and ErbB4, HER4 receptor proteins (see, e.g., Plowman et al. (1990), Proc. Natl. Acad. Sci. USA 87, 4905-4909; Hynes et. al. (1994) Biochim. Biophys. Acta Rev. Cancer 1198, 165-184). It is known that HER3 can bind multiple ligands, such as heregulin and the neuregulins 1 and 2; but that it lacks intrinsic tyrosine kinase activity (and because it is kinase inactive, the receptor can only initiate signal transduction when dimerized with another HER family member, such as HER1, HER2 or HER4).

More specifically, HER3 is a membrane-bound protein and has a neuregulin binding domain but not an active kinase domain. It therefore can bind this ligand but not convey the signal into the cell through protein phosphorylation. However, it does form heterodimers with other EGF receptor family members which do have kinase activity. Heterodimerization leads to the activation of pathways which lead to cell devision, proliferation, differentiation, migration and other cellular processes. Complex multilayered signaling generated receptor cross-talk and lateral signaling is becoming evident within the EGFR family and other receptor tyrosine kinases like MET (Engelmann et. al. (2007), Science 316, 1039-1043). Deregulated, aberrant signaling due to mutation, amplification and presence of active autrocrine loops may participate in development of cancer and other diseases. Amplification of this gene and/or overexpression of its protein have been reported in numerous cancers, including prostate, bladder, and breast tumors (see e.g. WO2008100624, WO2007077028, Horst et al. (2005) Int J Cancer, 115, 519-527; Xue et al. (2006) Cancer Res. 66, 1418-1426). HER3 is also known as LCCS2; ErbB-3; c-erbB3; erbB3-S; MDA-BF-1; MGC88033; c-erbB-3; p180-ErbB3; p45-sErbB3; p85-sErbB3; ERBB3.

When it comes to the role of HER3 in cancer, it has been suggested that HER3 may be necessary for HER2-mediated tumorigenesis, in the sense that HER2 may require HER3 in order to transform normal cells into cancer cells. For example, it has been found that increased expression of HER3 increases the signaling potency of HER2, whereas decreased HER3 expression results in the loss of HER2 activity. This has led to the hypothesis that HER3 may be involved in HER2-mediated tumorigenesis through dimerization with HER2.

It has also been suggested that HER3 may enable escape from inhibition of other HER receptors. For example, pre-clinical research has shown that upregulation of HER3 activity may be a mechanism by which tumor cells can escape tyrosine kinase inhibition of HER family receptors, and that tumor cells may compensate for tyrosine kinase inhibition of other HER receptors by increasing expression of HER3, which is kinase inactive. It has also been found that in HER2:HER3 heterodimers, HER2 transphosphorylates HER3.

HER3 has also been found to be overexpressed in several types of cancer (including without limitation breast and pancreatic cancer), and it has been found that there may be a correlation between the expression of HER2/HER3 and the progression from an non-invasive to an invasive stage (Baselga et al., 2009 Nature Reviews Cancer 9, 463-475).

Although, the role of HER3 in cancer and oncogenic signaling has been implicated (supra), its importance in an anti-cancer treatment remains unclear due to the complex ErbB network in which HER3 is a component thereof. Current immunotherapies primarily focus on inhibiting the action of HER2 and, in particular, heterodimerization of HER2/HER3 complexes (see, e.g., Sliwkowski et al. (1994) J. Biol. Chem. 269(20): 14661-14665).

It is an object of the present invention to provide improved immunotherapies that effectively inhibit HER3 signaling, and can be used to treat and diagnose a variety of cancers.

SUMMARY OF THE INVENTION

In the invention, a number of immunoglobulin single variable domains (as further described herein) have been identified and characterized (and where appropriate humanized and/or sequence optimized) that can bind to HER3 (and in particular specifically bind to HER3, as further defined herein) and that can (be used to) modulate (as defined herein) HER3 mediated signalling and/or modulate (some or all of) the biological effects of HER3 and/or modulate (some or all of) the biological mechanisms/pathways in which HER3 and/or HER3 mediated signalling is involved. It has also been found that the immunoglobulin single variable domains provided by the present invention can not only be used per se for such modulation, but can also with further advantage be linked to/combined with each other (i.e. so as to provide multivalent, multispecific and/or biparatopic constructs, as further defined herein) and/or with other moieties, binding domains or binding units to provide proteins, polypeptides or (other) compounds or constructs that can be used for such modulation.

Thus, the use of the immunoglobulin single variable domains (or "ISV's") provided by the invention as "building blocks" for providing such proteins, polypeptides or (other) compounds or constructs forms an important advantage and aspect of the invention.

For example, and with advantage but without limitation, it has been found that the various immunoglobulin single variable domains or "ISV's" provided by the invention can bind in different ways to HER3, and thus provide different modes-of-action in the way that they interact with HER3 and/or modulate HER3 mediated signalling. For example, some of the ISV's provided by the invention are capable of inhibiting binding of HRG to HER3, whereas others can bind to domain II of HER3 and/or block HER3 transphosphorylation. Yet others can block dimerisation of HER3 with itself of with other members of the HER family (such as HER1, HER2 or HER3). Hence, the amino acid of the invention (or ISV) is considered a building block.

Thus, the invention provides a range of different ISV's that can influence HER3, HER3 mediated signalling and/or the biological effects associated with HER3 and/or with HER3 mediated signalling.

In addition, when the ISV's provided by the invention are suitably used or combined as building blocks to provide further proteins, polypeptides or (other) compounds or constructs, the invention for example makes it possible, with advantage, to combine different interactions with HER3 and/or different mode-of-actions into a single molecule, compound, construct, protein or polypeptides. Examples of the same will become clear from the further description herein.

The effects or influence that the various ISV's, proteins, polypeptides, compounds and/or constructs that are provided by the invention have on HER3 and HER3 mediated signalling (including their mode/modes of action) can be determined using various suitable assays and in vivo models, such as an HER3 internalization assay (for example measuring reduction HER3 surface expression on a suitable cell such as MCF7 and MALME-3M cells); ligand blocking assays (such as HRG competition Alphascreen or FACS assays); HRG induced HER3 signalling blocking assays (such as an assay measuring inhibition of pHER3 in HER3-ligand stimulated MCF7, CHO-HER2-HER3, BT474 and MDA-MB468 cells); assays measuring heterodimerization blocking (such as pHER3 blocking of TGF-alpha-stimulated CHO-EGFR-HER3, β-cellulin-stimulated MDA-MB468 cells); assay measuring inhibition of downstream signalling (such as an assay measuring pAKT and/or pMAPK signaling in HER3-ligand stimulated MCF7, A549 and BT474 cells); or cell migration assays (such as assays measuring HRG induced migration of A431 cells). Reference is for example made to the Experimental Section and the results presented therein.

Thus, the ISV's, polypeptides and compositions of the present invention can generally be used to modulate, and in particular inhibit and/or prevent, binding of HER3 to Heregulin and/or blocking heterodimerization with MET, EGFR or HER2 (see e.g. Hsieh and Moasser, 2007, British Journal of Cancer), and thus to modulate, and in particular inhibit or prevent, the signalling that is mediated by HER3 and/or Heregulin, to modulate the biological pathways in which HER3 and/or Heregulin are involved, and/or to modulate the biological mechanisms, responses and effects associated with such signalling or these pathways.

As such, the polypeptides and compositions of the present invention can be used for the diagnosis and treatment (as defined herein) of a variety of cancers. Generally, "variety of cancers" can be defined as diseases and disorders that can be prevented and/or treated, respectively, by suitably administering to a subject in need thereof (i.e. having the disease or disorder or at least one symptom thereof and/or at risk of attracting or developing the disease or disorder) of either a polypeptide or composition of the invention (and in particular, of a pharmaceutically active amount thereof) and/or of a known active principle active against HER3 or a biological pathway or mechanism in which HER3 is involved (and in particular, of a pharmaceutically active amount thereof). Examples of such variety of cancers will be clear to the skilled person based on the disclosure herein, and for example include the following diseases and disorders: Cancer (Sithanandam and Anderson review (2008) Cancer Gene Therapy 15(7), 413-448; breast cancer (Lemoine et. al. (1992) Br J Cancer 66, 1116-1121; Witton et al. (2003) J Pathol 200(3):290-297; Koutras et al (2010) Crit. Rev Oncol Hematol. 74(2):73-78); lung cancer (Müller-Tidow (2005) Cancer Res 65(5):1778-1782; Timotheadou et al., (2007) Anticancer Res. 27(6C):4481-4489); ovarian cancer (Tanner et. al. (2006) J Clin Oncol 24(26): 4317-4323); prostate cancer (Lozano et. al. (2005) BMC Genomics 6:109; Soler et al., 2009. Int J Cancer 125(11):2565-2575) urinary bladder cancer (Rajkumar et. al. (1996) J Pathol, 179(4):381-385); brain cancer (Addo-Yobo et. al. (2006) J Neuropathol Exp Neurol 65(8):769-775, Andersson et. al. (2004) Acta Neuropathol, 108(2):135-142); Retinoblastoma (Chakraborty et. al. (2007) Genomics 90(3):344-353); melanoma (Segal et. al. (2003) J Clin Oncol. 2003 May 1; 21(9):1775-1781; Schaefer et. al. (2004) Cancer Res 64:3395-3405; Reschke et al., 2008 Clin Cancer Res. 14(16):5188-97); colorectal cancer (Grivas et. al. (2007) Eur J Cancer 43(17):2602-2611; Ciardiello et al. (1991) Proc Natl Acad Sci USA. 88(17):7792-7796); pancreatic cancer (Friess et. al. (1995) Clin Cancer Res 1(11):1413-20); Lemoine et al., 1992 J. Pathol. 168: 269-273); gastric cancer (Sanidas (1993), Int J Cancer 54(6):935-40, Hayashi et. al. (2008) Clin Cancer Res 14(23):7843-7849; Hayashi et al., (2008) Clin Cancer Res. 14(23):7843-9); head and neck cancer (Funayama (1998) Oncology 55(2):161-167, Erjala (2006) Clin Cancer Res 12(13):4103-4111); cervix cancer (Fuchs et al., 2007 Anticancer Res. 27(2):959-63); oesophagus cancer (Wei et al., 2007 Int J. Oncol. 31(3):493-9.); and/or nerve regeneration (Lindholm et. al. (2002) Exp Brain Res) 2002 January; 142(1):81-90.

In particular, the polypeptides and compositions of the present invention can be used for the diagnosis and treatment of variety of cancers which are characterized by excessive and/or unwanted signalling mediated by ErbB network of proteins or in general by any pathway(s) in which HER3 is involved. Examples of such variety of cancers will again be clear to the skilled person based on the disclosure herein.

Thus, without being limited thereto, it is also envisaged that the polypeptides of the invention can be used to prevent and/or to treat all diseases and disorders for which treatment with such active principles is currently being developed, has been proposed, or will be proposed or developed in future. In addition, it is envisaged that, because of their favourable properties as further described herein, the polypeptides of the present invention may be used for the prevention and treatment of other diseases and disorders than those for which these known active principles are being used or will be proposed or developed; and/or that the polypeptides of the present invention may provide new methods and regimens for treating the diseases and disorders described herein.

Other applications and uses of the amino acid sequences and polypeptides of the invention will become clear to the skilled person from the further disclosure herein.

Generally, it is an object of the invention to provide pharmacologically active agents, as well as compositions comprising the same, that can be used in the diagnosis, prevention and/or treatment of a variety of cancers and of the further diseases and disorders mentioned herein; and to provide methods for the diagnosis, prevention and/or treatment of such diseases and disorders that involve the administration and/or use of such agents and compositions.

In particular, it is an object of the invention to provide such pharmacologically active agents, compositions and/or methods that have certain advantages compared to the agents, compositions and/or methods that are currently used and/or known in the art. These advantages will become clear from the further description below.

More in particular, it is an object of the invention to provide therapeutic proteins that can be used as pharmacologically active agents, as well as compositions comprising the same, for the diagnosis, prevention and/or treatment of variety of cancers and of the further diseases and disorders mentioned herein; and to provide methods for the diagnosis, prevention and/or treatment of such diseases and disorders that involve the administration and/or the use of such therapeutic proteins and compositions.

Accordingly, it is a specific object of the present invention to provide amino acid sequences that are directed against (as defined herein) HER3, in particular against HER3 from a warm-blooded animal, more in particular against HER3 from a mammal, and especially against human HER3 (SEQ ID NO: 1); and to provide proteins and polypeptides comprising or essentially consisting of at least one such amino acid sequence.

In particular, it is a specific object of the present invention to provide such amino acid sequences and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences and such proteins and/or polypeptides that can be used for the prevention, treatment, alleviation and/or diagnosis of one or more diseases, disorders or conditions associated with HER3 and/or mediated by HER3 (such as the diseases, disorders and conditions mentioned herein) in a warm-blooded animal, in particular in a mammal, and more in particular in a human being.

It is also a specific object of the invention to provide such amino acid sequences and such proteins and/or polypeptides that can be used in the preparation of pharmaceutical or veterinary compositions for the prevention and/or treatment of one or more diseases, disorders or conditions associated with and/or mediated by HER3 (such as the diseases, disorders and conditions mentioned herein) in a warm-blooded animal, in particular in a mammal, and more in particular in a human being.

In the invention, generally, these objects are achieved by the use of the amino acid sequences, proteins, polypeptides and compositions that are described herein.

In general, the invention provides amino acid sequences that are directed against (as defined herein) and/or can specifically bind (as defined herein) to HER3; as well as compounds and constructs, and in particular proteins and polypeptides, that comprise at least one such amino acid sequence.

As already mentioned, in some specific, but non-limiting aspects (described in more detail herein), the invention provides:

amino acid sequences that are directed against (as defined herein) HER3 and that are capable of inhibiting or blocking (fully or partially, as further described herein) ligand binding, and in particular of inhibiting or blocking (fully or partially, as further described herein) the binding of HRG to HER3 (as further described herein). These amino acid sequences are also referred to herein as "HRG-blocking amino acid sequences" or "HRG-blocking building blocks". Preferably, these HRG-blocking amino acid sequences are ISV's (as described herein), in which case they are also referred to as "HRG-blocking ISV's". Preferably, any HRG-blocking amino acid sequences, HRG-blocking building blocks or HRG-blocking ISV's are such that they have blocking activity, i.e. block HRG binding to HER3 partially or completely, which can be determined by any suitable assay known to the person skilled in the art, such as, for instance, by an Alphascreen assay or by a FACS competition assay (e.g. as described herein). Preferably, the blocking activity is determined by a FACS competition assay as described in Example 9. Preferably, the ISV has a blocking activity or competition capacity in CHO cells of blocking or competing HRG1-β1 binding to HER3 with an IC50 of less than 600 nM, but preferably, 500 nM, 400 nM, 300 nM, 200 nM, 100 nM or even less.

For instance, the 04C07-like ISV has a blocking activity or competition capacity in this assay with an IC50 of less than 100 nM, more preferably, less than 75 nM, 50 nM or even less, such as less than 20 nM or 15 nM, 10 nM, 9 nM, 8 nM, 7 nM or 6 nM or even more preferably of less than 5 nM.

For instance, the 17B05-like ISV has a blocking activity or competition capacity in this assay with an IC50 of less than 150 nM, more preferably, less than 100 nM, 90 nM, 80 nM or even less, such as less than 70 nM or 60 nM, 50 nM or 40 nM or even more preferably of less than 35 nM.

For instance, the 21F06-like ISV has a blocking activity or competition capacity in this assay with an IC50 of less than 100 nM, more preferably, less than 80 nM, 70 nM or even less, such as less than 60 nM or 50 nM, 40 nM, 30 nM, 20 nM, 15 nM or 13 nM or even more preferably of less than 11 nM.

In one specific, but non-limiting aspect, (some of the) "HRG-blocking amino acid sequences" or "HRG-blocking building blocks" may (and preferably also are) be such that they are capable of inhibiting or blocking HER3 signaling (see Examples 9 and 10), for example in the phosphorylation assay used in Example 10. Preferably, any HRG-blocking amino acid sequences, HRG-blocking building blocks or HRG-blocking ISV's are such that they have blocking activity, i.e. block or inhibit HRG mediated HER3 phosphorylation partially or completely, which can be determined by any suitable assay known to the person skilled in the art, such as, for instance, by any suitable phosphorylation assay, such as, for instance, an HER3 phosphorylation assay, an AKT phosphorylation assay or ERK1/2 phosphorylation assay as described herein.

Preferably, the blocking activity or inhibiting capacity of phosphorylation is determined by a HER3 phosphorylation assay as described in Example 10. Preferably, the ISV has a blocking activity or an inhibition capacity of ligand (e.g. HRG1-β1) induced pHER3 phosphorylation in MCF-7 cells with an IC50 of less than 600 nM, but preferably, 500 nM, 400 nM, 300 nM, 200 nM, 100 nM or even less.

For instance, the 04C07-like ISV has a blocking activity or competition capacity of in this assay with an IC50 of less than 100 nM, more preferably, less than 75 nM, 50 nM or even less, such as less than 20 nM or 15 nM, 10 nM, 9 nM, 8 nM, 7 nM or 6 nM or even more preferably of less than 5, 4, 3 or 2 nM.

For instance, the 17B05-like ISV has a blocking activity or competition capacity of in this assay with an IC50 of less than 150 nM, more preferably, less than 100 nM, 90 nM, 80 nM or even less, such as less than 70 nM or 60 nM, 50 nM or 40 nM or even more preferably of less than 35 nM, such as less than 20 nM or 15 nM, 10 nM, 9 nM, 8 nM or 7 nM or even more preferably of less than 6 nM.

For instance, the 21F06-like ISV has a blocking activity or competition capacity of in this assay with an IC50 of less than 150 nM, more preferably, less than 100 nM, 90 nM, 80 nM or even less, such as less than 70 nM or 60 nM, 50 nM or 40 nM or even more preferably of less than 35 nM, such as less than 20 nM or 15 nM, 10 nM, 9 nM, 8 nM or even more preferably of less than 7 nM.

Preferably, the blocking activity or inhibiting capacity of signaling is determined by an AKT phosphorylation assay as described in Example 10.1. Preferably, the ISV has a blocking activity or an inhibition capacity of ligand (e.g. HRG1-β1) induced Akt-phosphorylation in MCF-7 cells with an IC50 of less than 600 nM, but preferably, 500 nM, 400 nM, 300 nM, 200 nM, 100 nM or even less.

For instance, the 04C07-like ISV has a blocking activity or competition capacity of in this assay with an IC50 of less than 100 nM, more preferably, less than 80 nM, 70 nM or even less, such as less than 60 nM or 50 nM, 45 nM, 40 nM, 35 nM, 30 nM or even more preferably of less than 20 nM.

For instance, the 17B05-like ISV has a blocking activity or competition capacity of in this assay with an IC50 of less than 150 nM, more preferably, less than 100 nM, 90 nM, 80 nM or even less, such as less than 70 nM or 60 nM, 50 nM or 40 nM or even more preferably of less than 35 nM, such as less than 20 nM or 15 nM, 12 nM, 11 nM, 10 nM or 9 nM or even more preferably of less than 8 nM.

For instance, the 21F06-like ISV has a blocking activity or competition capacity of in this assay with an IC50 of less than 150 nM, more preferably, less than 100 nM, 90 nM, 80 nM or even less, such as less than 70 nM or 60 nM, 55 nM or 50 nM or even more preferably of less than 45 nM, such as less than 40 nM or 35 nM, 30 nM, 27.5 nM, 25 nM or even more preferably of less than 24 nM.

Preferably, the blocking activity or inhibiting capacity of signaling is determined by an ERK1/2 phosphorylation assay as described in Example 10.2. Preferably, the ISV has a blocking activity or an inhibition capacity of ligand (e.g. HRG1-β1) induced ERK1/2-phosphorylation in MCF-7 cells with an IC50M of less than 600 nM, but preferably, 500 nM, 400 nM, 300 nM, 200 nM, 150 nM or even less.

For instance, the 04C07-like ISV has a blocking activity or competition capacity of in this assay with an IC50 of less than 150 nM, more preferably, less than 100 nM, 90 nM, 80 nM or even less, such as less than 80 nM, 70 nM or 60 nM, 55 nM or 50 nM or even more preferably of less than 45 nM, such as less than 40 nM or 35 nM or even more preferably of less than 30 nM.

For instance, the 17B05-like ISV has a blocking activity or competition capacity of in this assay with an IC50 of less than 150 nM, more preferably, less than 100 nM, 90 nM, 80 nM or even less, such as less than 70 nM or 60 nM, 50 nM or 40 nM or even more preferably of less than 35 nM, such as less than 20 nM or 15 nM, 10 nM, 7.5 nM, 5 nM or 4 nM or even more preferably of less than 3 nM.

For instance, the 21F06-like ISV has a blocking activity or competition capacity of in this assay with an IC50 of less than 150 nM, such as preferably less than 120 nM.

In yet another specific but non-limiting aspect, an HRG-blocking amino acid sequence (or HRG-blocking ISV) is an amino acid sequence (or ISV) that competes with either the amino acid sequence 21F06 (SEQ ID NO: 22) and/or the amino acid sequence 04C07 (SEQ ID NO: 15) for binding to HER3 and/or that is capable of cross-blocking (as defined herein) the binding of 21F06 and/or of 04C07 to HER3, for example and in particular in the assay described in Example 2 (section 2.9). Some preferred, but non-limiting examples of such HRG-blocking ISV's are the "21F06-like sequences" and the "04C07-like sequences" as further described herein. Some of the 21F06-like sequences may be non-limiting examples of ISV's of the invention that are capable of both blocking/inhibiting ligand binding as well as inhibiting/blocking signaling. Similarly, the 17B05-like sequences described herein are examples of ISV's of the invention that are capable of both blocking/inhibiting (trans) phosphorylation as well as ligand/HRG binding.

The invention provides amino acid sequences that are directed against (as defined herein) HER3 and that are capable of inhibiting or blocking (fully or partially, as further described herein) (hetero)dimerisation of HER3 (as further described herein), such as EGFR/HER1-HER3 (hetero)dimerisation (see for example Examples 13 and 16) and/or HER-2/HER3 (hetero)dimersation), for example in the HER-1/HER3 (hetero)dimerisation assay used in Example 13. These amino acid sequences are also referred to herein as "dimerisation-blocking amino acid sequences" or "dimerisation-blocking building blocks". Preferably, these dimerisation-blocking amino acid sequences are ISV's (as described herein), in which case they are also referred to as "dimerisation-blocking ISV's". Preferably, any dimerisation-blocking amino acid sequences, dimerisation-blocking building blocks or dimerisation-blocking ISV's are such that they block or inhibit (hetero)dimerisation, i.e. block or inhibit dimerisation of HER3 with MET, EGFR and/or HER2 partially or completely, which can be determined by any suitable assay known to the person skilled in the art, such as, for instance, by a transphosphorylation assay (e.g. as described herein). Preferably, the blocking or inhibiting capacity is determined by a transphosphorylation assay as described in Example 10 or 13, for instance, by determining the EGFR ligand (e.g. TGF-α) induced HER3 transphosphorylation as measured in cellular assay in MDA MB468 cells or CHO EGFR/HER3 cells.

Preferably, the ISV has a blocking or inhibiting activity of (hetero)dimerisation in CHO EGFR/HER3 cells of blocking or inhibiting dimerisation of HER3 with EGFR with an IC50 of less than 600 nM, but preferably, 500 nM, 400 nM, 300 nM, 200 nM, 100 nM or even less.

For instance, the 17B05-like ISV has a blocking activity or inhibiting capacity of in this assay with an IC50 of less than 100 nM, more preferably, less than 75 nM, 50 nM or even less, such as less than 20 nM or 15 nM, 10 nM, 5 nM, 4 nM, 3 nM or 2 nM or even more preferably of less than 1 nM.

In one specific, but non-limiting aspect, (some of the) dimerisation-blocking amino acid sequences or dimerisation-blocking building blocks may (and preferably also are) such that they are capable of inhibiting or blocking (fully or partially, as further described herein) ligand binding, and in particular of inhibiting or blocking (fully or partially, as further described herein) the binding of HRG to HER3. In one specific but non-limiting aspect, a dimerisation-blocking amino acid sequence (or dimerisation-blocking ISV) is an amino acid sequence (or ISV) that competes with the amino acid sequence 17B05 (SEQ ID NO: 13) for binding to HER3 and/or that is capable of cross-blocking (as defined herein) the binding of 17B05 to HER3, for example and in particular in the assay described in Example 2 (section 2.9) and Example 8. Some preferred, but non-limiting examples of such dimerisation-blocking ISV's are the "17B05-like sequences" as further described herein. At least some of these 17B05-like sequences are also non-limiting examples of ISV's of the invention that are capable of both blocking/inhibiting (trans)phosphorylation as well as ligand/HRG binding. The invention provides amino acid sequences that are directed against (as defined herein) HER3 and that are capable of binding to domain II of HER3. These amino acid sequences are also referred to herein as "domain II-binding amino acid sequences" or "domain II-binding building blocks". Preferably, these domain II-binding amino acid sequences are ISV's (as described herein), in which case they are also referred to as "domain II-binding ISV's". Preferably, any domain II-binding amino acid sequences, domain II-binding building blocks or domain II-binding ISV's are such that they bind to domain II of HER3, which can be determined by any suitable assay known to the person skilled in the art, such as, for instance, by epitope competition or domain swapping assays (e.g. as described herein). Preferably, the binding capacity to domain II is determined by binding to chimeric HER3 proteins as described in Example 8, for instance, by swapping human HER3 domains with chicken HER3 domains.

The domain II-binding amino acid sequences/ISV's or domain II-binding building blocks/ISV's provided by the invention may also have an effect (which may be limited/partial or more pronounced) on either ligand/HRG binding (in particular, they may to a limited/partial extent be capable of inhibiting or blocking the binding of ligand/HRG to HER3) and/or on the (hetero)dimerization of HER3.

In one specific, but non-limiting aspect, (some of the) "domain II-binding amino acid sequences" or "domain II-binding building blocks" may (and preferably also are) be such that they are capable of inhibiting or blocking HER3 phosphorylation (see Example 10), for instance in the phosphorylation assay used in Example 10. Preferably, any domain II-binding amino acid sequences or domain II-binding building blocks or domain II-binding ISV's are such that they have blocking activity, i.e. block or inhibit HRG mediated HER3 phosphorylation partially or completely, which can be determined by any suitable assay known to the person skilled in the art, such as, for instance, by any suitable phosphorylation assay, such as, for instance, an HER3 phosphorylation assay, an AKT phosphorylation assay or ERK1/2 phosphorylation assay as described herein.

Preferably, the blocking activity or inhibiting capacity of phosphorylation is determined by a HER3 phosphorylation assay as described in Example 10. Preferably, the ISV has a blocking activity or an inhibition capacity of ligand (e.g. HRG1-β1) induced pHER3 phosphorylation in MCF-7 cells with an IC50 of less than 600 nM, but preferably, 500 nM, 400 nM, 300 nM, 200 nM, 100 nM or even less.

For instance, the 18G11-like ISV has a blocking activity or competition capacity of in this assay with an IC50 of less than 150 nM, more preferably, less than 100 nM, 90 nM, 80 nM or even less, such as less than 70 nM or 60 nM, 50 nM or 40 nM or even more preferably of less than 35 nM, such as less than 20 nM or 15 nM, 14 nM, 13 nM, 12 nM or even more preferably of less than 11 nM.

For instance, the 34C07-like ISV has a blocking activity or competition capacity of in this assay with an IC50 of less than 150 nM, more preferably, less than 100 nM, 90 nM, 80 nM or even less, such as less than 70 nM or 60 nM, 50 nM or 40 nM or even more preferably of less than 35 nM, such as less than 20 nM or 16 nM, 15 nM, 14 nM, 13 nM or even more preferably of less than 12 nM.

Preferably, the blocking activity or inhibiting capacity of phosphorylation is determined by an AKT phosphorylation assay as described in Example 10.1. Preferably, the ISV has a blocking activity or an inhibition capacity of ligand (e.g. HRG1-β1) induced Akt-phosphorylation in MCF-7 cells with an IC50 of less than 600 nM, but preferably, 500 nM, 400 nM, 300 nM, 200 nM, 150 nM or even less.

For instance, the 18G11-like ISV has a blocking activity or competition capacity of in this assay with an IC50 of less than 150 nM, more preferably, less than 140 nM.

For instance, the 34C07-like ISV has a blocking activity or competition capacity of in this assay with an IC50 of less than 150 nM, more preferably, less than 100 nM or 90 nM, 80 nM, 70 nM, 60 nM or even more preferably of less than 50 nM.

Preferably, the blocking activity or inhibiting capacity of phosphorylation is determined by an ERK1/2 phosphorylation assay as described in Example 10.2. Preferably, the ISV has a blocking activity or an inhibition capacity of ligand (e.g. HRG1-β1) induced ERK1/2-phosphorylation in MCF-7 cells with an IC50M of less than 600 nM, but preferably, 500 nM, 400 nM, 300 nM, 200 nM, 150 nM or even less.

For instance, the 34C07-like ISV has a blocking activity or competition capacity of in this assay with an IC50 of less than 150 nM, such as less than 120 nM.

In one specific but non-limiting aspect, a domain II-binding amino acid sequence (or domain II-binding ISV) is an amino acid sequence (or ISV) that competes with the amino acid sequence 18G11 (SEQ ID NO: 16) and/or with the amino acid sequence 34C07 (SEQ ID NO: 18) for binding to HER3 and/or that is capable of cross-blocking (as defined herein) the binding of 18G11 and/or of 34C07 to HER3, for example and in particular in the assay described in Example 2 (section 2.9). Also, in one specific but non-limiting aspect, a domain II-binding amino acid sequence is capable of inhibiting or blocking HER3 phosphorylation (see Examples 9 and 10), for example in the phosphorylation assay used in Example 10, preferably essentially without blocking or substantially inhibiting ligand binding. Some preferred, but non-limiting examples of such domain II-binding ISV's are the "18G11-like sequences" and the "34C07-like sequences" as further described herein. Of these, some of the 34C07-like sequences are examples of ISV's of the invention that not only bind to domain II, but also to a limited/partial extent are capable of inhibiting ligand/HER3 binding.

Also, in the present description and claims, the following terms are defined as follows:

A) 21F06-like sequences: a "21F06-like sequence","21F06-like ISV" or "21F06-like building block" is defined as an ISV (as described herein) that comprises:

a) a CDR1 which comprises or essentially consists of either (i) the amino acid sequence LNAMG (SEQ ID NO: 67) or (ii) an amino acid sequence that has only 3, 2 or 1 amino acid difference(s) (as defined herein) with the amino acid sequence LNAMG; and/or b) a CDR2 which comprises or essentially consists of either (i) the amino acid sequence AIDWSDGNKDYADSVKG (SEQ ID NO: 97) or (ii) an amino acid sequence that has at least 80%, such as at least 85%, for example at least 90% or more than 95% sequence identity with the amino acid sequence AIDWSDGNKDYADSVKG; or (iii) an amino acid sequence that has only 7, 6, 5, 4, 3, 2 or 1 amino acid difference(s) (as defined herein) with the amino acid sequence AIDWSDGNKDYADSVKG; and/or c) a CDR3 which comprises or essentially consists of either (i) the amino acid sequence DTPPWGPMIYIESYDS (SEQ ID NO: 127) or (ii) an amino acid sequence that has at least 80%, such as at least 85%, for example at least 90% or more than 95% sequence identity with the amino acid sequence DTPPWGPMIYIESYDS; or (iii) an amino acid sequence that has only 7, 6, 5, 4, 3, 2 or 1 amino acid difference(s) (as defined herein) with the amino acid sequence DTPPWGPMIYIESYDS;

in which the framework sequences present in such an ISV are as further described herein, and in which CDR1, CDR2 and CDR3 are preferably such that the 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

As also mentioned herein, (some of the) 21F06-like sequences may (and preferably also are) be such that they are capable of inhibiting or blocking HER3 phosphorylation (see Examples 9 and 10), for example in the phosphorylation assay used in Example 10. Preferably, in such a 21F06-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 21F06-like sequence, CDR1, CDR2 and CDR3 are all as defined under a), b) and c), respectively. Again, in such an 21F06-like sequence, CDR1, CDR2 and CDR3 are preferably such that the 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above above.

For example, in such an 21F06-like sequence: CDR1 may comprise or essentially consist of the amino acid sequence LNAMG (with CDR2 and CDR3 being as defined under b) and c), respectively); and/or CDR2 may comprise or essentially consist of the amino acid sequence AIDWSDGNKDYADSVKG (with CDR1 and CDR3 being as defined under a) and c), respectively); and/or CDR3 may comprise or essentially consist of the amino acid sequence DTPPWGPMIYIESYDS (with CDR1 and CDR2 being as defined under a) and b), respectively). Particularly, when an 21F06-like sequence is according to this aspect: CDR1 may comprise or essentially consist of the amino acid sequence LNAMG and CDR2 may comprise or essentially consist of the amino acid sequence AIDWSDGNKDYADSVKG (with CDR3 being as defined under c) above); and/or CDR1 may comprise or essentially consist of the amino acid sequence LNAMG and CDR3 may comprise or essentially consist of the amino acid sequence DTPPWGPMIYIESYDS (with CDR2 being as defined under b) above); and/or CDR2 may comprise or essentially consist of the amino acid sequence AIDWSDGNKDYADSVKG and CDR3 may comprise or essentially consist of the amino acid sequence DTPPWGPMIYIESYDS (with CDR1 being as defined under a) above). Again, in such 21F06-like sequences, CDR1, CDR2 and CDR3 are preferably such that the 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above. In a specifically preferred aspect, a "21F06-like sequence", "21F06-like ISV" or "21F06-like building block" is an ISV that comprises:

d) a CDR1 which is either (i) the amino acid sequence LNAMG or (ii) an amino acid sequence that has only 3, 2 or 1 amino acid difference(s) (as defined herein) with the amino acid sequence LNAMG; and/or e) a CDR2 which is either (i) the amino acid sequence AIDWSDGNKDYADSVKG or (ii) an amino acid sequence that has at least 80%, such as at least 85%, for example at least 90% or more than 95% sequence identity with the amino acid sequence AIDWSDGNKDYADSVKG; or (iii) an amino acid sequence that has only 7, 6, 5, 4, 3, 2 or 1 amino acid difference(s) (as defined herein) with the amino acid sequence AIDWSDGNKDYADSVKG; and/or f) a CDR3 which is either (i) the amino acid sequence DTPPWGPMIYIESYDS or (ii) an amino acid sequence that has at least 80%, such as at least 85%, for example at least 90% or more than 95% sequence identity with the amino acid sequence DTPPWGPMIYIESYDS; or (iii) an amino acid sequence that has only 7, 6, 5, 4, 3, 2 or 1 amino acid difference(s) (as defined herein) with the amino acid sequence DTPPWGPMIYIESYDS;

in which the framework sequences present in such an ISV are as further described herein, and in which CDR1, CDR2 and CDR3 are preferably such that the 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

Preferably, in a 21F06-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 21F06-like sequence, CDR1, CDR2 and CDR3 are all as defined under d), e) and f), respectively. Again, in such an 21F06-like sequence, CDR1, CDR2 and CDR3 are preferably such that the 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above above.

For example, in a 21F06-like sequence according to this specifically preferred aspect: CDR1 is the amino acid sequence LNAMG (with CDR2 and CDR3 being as defined under e) and f), respectively); and/or CDR2 is the amino acid sequence AIDWSDGNKDYADSVKG (with CDR1 and CDR3 being as defined under d) and f), respectively); and/or CDR3 is the amino acid sequence DTPPWGPMIYIESYDS (with CDR1 and CDR2 being as defined under d) and e), respectively). Particularly, when an 21F06-like sequence is according to this aspect: CDR1 is the amino acid sequence LNAMG and CDR2 is the amino acid sequence AIDWSDGNKDYADSVKG (with CDR3 being as defined under 0 above); and/or CDR1 is the amino acid sequence LNAMG and CDR3 is the amino acid sequence DTPPWGPMIYIESYDS (with CDR2 being as defined under e) above); and/or CDR2 is the amino acid sequence AIDWSDGNKDYADSVKG and CDR3 is DTPPWGPMIYIESYDS (with CDR1 being as defined under d) above). Again, in such 21F06-like sequences, CDR1, CDR2 and CDR3 are preferably such that the 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above above.

In a particularly preferred 21F06-like sequence: CDR1 is the amino acid sequence LNAMG, CDR2 is the amino acid sequence AIDWSDGNKDYADSVKG; and CDR3 is the amino acid sequence DTPPWGPMIYIESYDS.

In all the 21F06-like sequence described in this paragraph A), the framework sequences may be as further described herein. Preferably, the framework sequences are such that the framework sequences have at least 80%, such as at least 85%, for example at least 90%, such as at least 95% sequence identity with the framework sequences of 21F06 (which, for example, can be determined by determining the overall degree of sequence identity of a given sequence with the sequence of 21F06 while disregarding the CDR's in the calculation). Again, the combination of CDR's and frameworks present in a given sequence are preferably such that the resulting 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above. In one specific aspect, a 21F06-like sequence is an ISV that has at least 70%, such at least 80%, for example at least 85%, such as at least 90% or more than 95% sequence identity with the amino acid sequence 21F06 (SEQ ID NO: 22). For example, in an 21F06-like sequence according to this aspect, the CDR's may be according to the specifically preferred aspect described above, and may in particularly (but without limitation) be LNAMG (CDR1); AIDWSDGNKDYADSVKG (CDR2); and DTPPWGPMIYIESYDS (CDR3). Again, preferably, the combination of CDR's and frameworks present in such a 21F06-like ISV are preferably such that the resulting 21F06-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

In one particular aspect, any 21F06-like sequence may be a humanized and/or sequence optimized sequence, as further described herein.

B) 04C07-like sequences: a "04C07-like sequence", "04C07-like ISV" or "04C07-like building block" is defined as an ISV (as described herein) that comprises:
  a) a CDR1 which comprises or essentially consists of either (i) the amino acid sequence SYPMS (SEQ ID NO: 60) or (ii) an amino acid sequence that has only 3, 2 or 1 amino acid difference(s) (as defined herein) with the amino acid sequence SYPMS; and/or
  b) a CDR2 which comprises or essentially consists of either (i) the amino acid sequence TVSPGGITTSYADSVKG (SEQ ID NO: 90) or (ii) an amino acid sequence that has at least 80%, such as at least 85%, for example at least 90% or more than 95% sequence identity with the amino acid sequence TVSPGGITTSYADSVKG; or (iii) an amino acid sequence that has only 7, 6, 5, 4, 3, 2 or 1 amino acid difference(s) (as defined herein) with the amino acid sequence TVSPGGITTSYADSVKG; and/or
  c) a CDR3 which comprises or essentially consists of either (i) the amino acid sequence DLNN (SEQ ID NO: 120) or (ii) an amino acid sequence that has at least 50%, such as at least 75% sequence identity with the amino acid sequence DLNN; or (iii) an amino acid sequence that has only 2 or 1 amino acid difference(s) (as defined herein) with the amino acid sequence DLNN;

in which the framework sequences present in such an ISV are as further described herein, and in which CDR1, CDR2 and CDR3 are preferably such that the 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

Preferably, in such a 04C07-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 04C07-like sequence, CDR1, CDR2 and CDR3 are all as defined under a), b) and c), respectively. Again, in such an 04C07-like sequence, CDR1, CDR2 and CDR3 are preferably such that the 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above above.

For example, in such an 04C07-like sequence: CDR1 may comprise or essentially consist of the amino acid sequence SYPMS (with CDR2 and CDR3 being as defined under b) and c), respectively); and/or CDR2 may comprise or essentially consist of the amino acid sequence TVSPGGITTSYADSVKG (with CDR1 and CDR3 being as defined under a) and c), respectively); and/or CDR3 may comprise or essentially consist of the amino acid sequence DLNN (with CDR1 and CDR2 being as defined under a) and b), respectively). Particularly, when an 04C07-like sequence is according to this aspect: CDR1 may comprise or essentially consist of the amino acid sequence SYPMS and CDR2 may comprise or essentially consist of the amino acid sequence TVSPGGITTSYADSVKG (with CDR3 being as defined under c) above); and/or CDR1 may comprise or essentially consist of the amino acid sequence SYPMS and CDR3 may comprise or essentially consist of the amino acid sequence DLNN (with CDR2 being as defined under b) above); and/or CDR2 may comprise or essentially consist of the amino acid sequence TVSPGGITTSYADSVKG and CDR3 may comprise or essentially consist of the amino acid sequence DLNN (with CDR1 being as defined under a) above). Again, in such 04C07-like sequences, CDR1, CDR2 and CDR3 are preferably such that the 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

In a specifically preferred aspect, a "04C07-like sequence", "04C07-like ISV" or "04C07-like building block" is an ISV that comprises:
  d) a CDR1 which is either (i) the amino acid sequence SYPMS or (ii) an amino acid sequence that has only 3, 2 or 1 amino acid difference(s) (as defined herein) with the amino acid sequence SYPMS; and/or
  e) a CDR2 which is either (i) the amino acid sequence TVSPGGITTSYADSVKG or (ii) an amino acid sequence that has at least 80%, such as at least 85%, for example at least 90% or more than 95% sequence identity with the amino acid sequence TVSPGGITTSYADSVKG; or (iii) an amino acid sequence that has only 7, 6, 5, 4, 3, 2 or 1 amino acid difference(s) (as defined herein) with the amino acid sequence TVSPGGITTSYADSVKG; and/or
  f) a CDR3 which is either (i) the amino acid sequence DLNN or (ii) an amino acid sequence that has at least 50%, such as at least 75%, sequence identity with the amino acid sequence DLNN; or (iii) an amino acid sequence that has only 2 or 1 amino acid difference(s) (as defined herein) with the amino acid sequence DLNN;

in which the framework sequences present in such an ISV are as further described herein, and in which CDR1, CDR2 and CDR3 are preferably such that the 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

Preferably, in a 04C07-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 04C07-like sequence, CDR1, CDR2 and CDR3 are all as defined under d), e) and f), respectively. Again, in such an 04C07-like sequence, CDR1, CDR2 and CDR3 are preferably such that the 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

For example, in a 04C07-like sequence according to this specifically preferred aspect: CDR1 is the amino acid sequence SYPMS (with CDR2 and CDR3 being as defined under e) and f), respectively); and/or CDR2 is the amino acid sequence TVSPGGITTSYADSVKG (with CDR1 and CDR3 being as defined under d) and f), respectively); and/or CDR3 is the amino acid sequence DLNN (with CDR1 and CDR2 being as defined under d) and e), respectively). Particularly, when an 04C07-like sequence is according to this aspect: CDR1 is the amino acid sequence SYPMS and CDR2 is the amino acid sequence TVSPGGITTSYADSVKG (with CDR3 being as defined under f) above); and/or CDR1 is the amino acid sequence SYPMS and CDR3 is the amino acid sequence DLNN (with CDR2 being as defined under e) above); and/or CDR2 is the amino acid sequence TVSPGGITTSYADSVKG and CDR3 is DLNN (with CDR1 being as defined under d) above). Again, in such 04C07-like sequences, CDR1, CDR2 and CDR3 are preferably such that the 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

In a particularly preferred 04C07-like sequence: CDR1 is the amino acid sequence SYPMS, CDR2 is the amino acid sequence TVSPGGITTSYADSVKG; and CDR3 is the amino acid sequence DLNN.

In all the 04C07-like sequence described in this paragraph B), the framework sequences may be as further described herein. Preferably, the framework sequences are such that the framework sequences have at least 80%, such as at least 85%, for example at least 90%, such as at least 95% sequence identity with the framework sequences of 04C07 (which, for example, can be determined by determining the overall degree of sequence identity of a given sequence with the sequence of 04C07 while disregarding the CDR's in the calculation). Again, the combination of CDR's and frameworks present in a given sequence are preferably such that the resulting 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

In one specific aspect, a 04C07-like sequence is an ISV that has at least 70%, such at least 80%, for example at least 85%, such as at least 90% or more than 95% sequence identity with the amino acid sequence 04C07 (SEQ ID NO: 15). For example, in an 04C07-like sequence according to this aspect, the CDR's may be according to the specifically preferred aspect described above, and may in particularly (but without limitation) be SYPMS (CDR1); TVSPGGITTSYADSVKG (CDR2); and DLNN (CDR3). Again, preferably, the combination of CDR's and frameworks present in such a 04C07-like ISV are preferably such that the resulting 04C07-like ISV has blocking activity, e.g. block HRG binding to HER3 partially or completely as described above, and/or blocking activity or inhibiting capacity of phosphorylation in a HER3 phosphorylation assay, and/or pAKT phosphorylation assay, and/or ERK1/2 phosphorylation assay, all as described above.

In one particular aspect, any 04C07-like sequence may be a humanized and/or sequence optimized sequence, as further described herein.

C) 17B05-like sequences: a "17B05-like sequence", "17B05-like ISV" or "17B05-like building block" is defined as an ISV (as described herein) that comprises:
a) a CDR1 which comprises or essentially consists of either (i) the amino acid sequence LNAMA (SEQ ID NO: 58) or (ii) an amino acid sequence that has only 3, 2 or 1 amino acid difference(s) (as defined herein) with the amino acid sequence LNAMA; and/or
b) a CDR2 which comprises or essentially consists of either (i) the amino acid sequence GIFGVGSTRYADSVKG (SEQ ID NO: 88) or (ii) an amino acid sequence that has at least 80%, such as at least 85%, for example at least 90% or more than 95% sequence identity with the amino acid sequence GIFGVGSTRYADSVKG; or (iii) an amino acid sequence that has only 7, 6, 5, 4, 3, 2 or 1 amino acid difference(s) (as defined herein) with the amino acid sequence GIFGVGSTRYADSVKG; and/or
c) a CDR3 which comprises or essentially consists of either (i) the amino acid sequence SSVTRGSSDY (SEQ ID NO: 118) or (ii) an amino acid sequence that has at least 80%, such as at least 85%, for example at least 90% or more than 95% sequence identity with the amino acid sequence SSVTRGSSDY; or (iii) an amino acid sequence that has only 7, 6, 5, 4, 3, 2 or 1 amino acid difference(s) (as defined herein) with the amino acid sequence SSVTRGSSDY;

in which the framework sequences present in such an ISV are as further described herein, and in which CDR1, CDR2 and CDR3 are preferably such that the 17B05-like ISV has blocking activity, e.g. block HRG binding to HER3 partially or completely as described above, and/or blocking activity or inhibiting capacity of (trans)phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above.

As mentioned herein, (some of the) 17B05-like sequences may be (and preferably are) such that they are capable of inhibiting or blocking (fully or partially, as further described herein) ligand binding, and in particular of inhibiting or blocking (fully or partially, as further described herein) the binding of HRG to HER3

Preferably, in such a 17B05-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 17B05-like sequence, CDR1, CDR2 and CDR3 are all as defined under a), b) and c), respectively. Again, in such an 17B05-like sequence, CDR1, CDR2 and CDR3 are preferably such that the 17B05-like ISV has blocking activity, e.g. block HRG binding to HER3 partially or completely as described above, and/or blocking activity or inhibiting capacity of (trans) phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above.

For example, in such an 17B05-like sequence: CDR1 may comprise or essentially consist of the amino acid sequence LNAMA (with CDR2 and CDR3 being as defined under b) and c), respectively); and/or CDR2 may comprise or essentially consist of the amino acid sequence GIFGVGSTRYADSVKG (with CDR1 and CDR3 being as defined under a)

and c), respectively); and/or CDR3 may comprise or essentially consist of the amino acid sequence SSVTRGSSDY (with CDR1 and CDR2 being as defined under a) and b), respectively). Particularly, when an 17B05-like sequence is according to this aspect: CDR1 may comprise or essentially consist of the amino acid sequence LNAMA and CDR2 may comprise or essentially consist of the amino acid sequence GIFGVGSTRYADSVKG (with CDR3 being as defined under c) above); and/or CDR1 may comprise or essentially consist of the amino acid sequence LNAMA and CDR3 may comprise or essentially consist of the amino acid sequence SSVTRGSSDY (with CDR2 being as defined under b) above); and/or CDR2 may comprise or essentially consist of the amino acid sequence GIFGVGSTRYADSVKG and CDR3 may comprise or essentially consist of the amino acid sequence SSVTRGSSDY (with CDR1 being as defined under a) above). Again, in such 17B05-like sequences, CDR1, CDR2 and CDR3 are preferably such that the 17B05-like ISV has blocking activity, e.g. block HRG binding to HER3 partially or completely as described above, and/or blocking activity or inhibiting capacity of (trans) phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above.

In a specifically preferred aspect, a "17B05-like sequence", "17B05-like ISV" or "/7B05-like building block" is an ISV that comprises:

d) a CDR1 which is either (i) the amino acid sequence LNAMA or (ii) an amino acid sequence that has only 3, 2 or 1 amino acid difference(s) (as defined herein) with the amino acid sequence LNAMA; and/or e) a CDR2 which is either (i) the amino acid sequence GIFGVGSTRYADSVKG or (ii) an amino acid sequence that has at least 80%, such as at least 85%, for example at least 90% or more than 95% sequence identity with the amino acid sequence GIFGVGSTRYADSVKG; or (iii) an amino acid sequence that has only 7, 6, 5, 4, 3, 2 or 1 amino acid difference(s) (as defined herein) with the amino acid sequence GIFGVGSTRYADSVKG; and/or f) a CDR3 which is either (i) the amino acid sequence SSVTRGSSDY or (ii) an amino acid sequence that has at least 80%, such as at least 85%, for example at least 90% or more than 95% sequence identity with the amino acid sequence SSVTRGSSDY; or (iii) an amino acid sequence that has only 7, 6, 5, 4, 3, 2 or 1 amino acid difference(s) (as defined herein) with the amino acid sequence SSVTRGSSDY;

in which the framework sequences present in such an ISV are as further described herein, and in which CDR1, CDR2 and CDR3 are preferably such that the 17B05-like ISV has blocking activity, e.g. block HRG binding to HER3 partially or completely as described above, and/or blocking activity or inhibiting capacity of (trans)phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above.

Preferably, in a 17B05-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 17B05-like sequence, CDR1, CDR2 and CDR3 are all as defined under d), e) and f), respectively. Again, in such an 17B05-like sequence, CDR1, CDR2 and CDR3 are preferably such that the 17B05-like ISV has blocking activity, e.g. block HRG binding to HER3 partially or completely as described above, and/or blocking activity or inhibiting capacity of (trans)phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above.

For example, in a 17B05-like sequence according to this specifically preferred aspect: CDR1 is the amino acid sequence LNAMA (with CDR2 and CDR3 being as defined under e) and f), respectively); and/or CDR2 is the amino acid sequence GIFGVGSTRYADSVKG (with CDR1 and CDR3 being as defined under d) and f), respectively); and/or CDR3 is the amino acid sequence SSVTRGSSDY (with CDR1 and CDR2 being as defined under d) and e), respectively). Particularly, when an 17B05-like sequence is according to this aspect: CDR1 is the amino acid sequence LNAMA and CDR2 is the amino acid sequence GIFGVGSTRYADSVKG (with CDR3 being as defined under f) above); and/or CDR1 is the amino acid sequence LNAMA and CDR3 is the amino acid sequence SSVTRGSSDY (with CDR2 being as defined under e) above); and/or CDR2 is the amino acid sequence GIFGVGSTRYADSVKG and CDR3 is SSVTRGSSDY (with CDR1 being as defined under d) above). Again, in such 17B05-like sequences, CDR1, CDR2 and CDR3 are preferably such that the 17B05-like ISV has blocking activity, e.g. block HRG binding to HER3 partially or completely as described above, and/or blocking activity or inhibiting capacity of (trans)phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above.

In a particularly preferred 17B05-like sequence: CDR1 is the amino acid sequence LNAMA, CDR2 is the amino acid sequence GIFGVGSTRYADSVKG; and CDR3 is the amino acid sequence SSVTRGSSDY.

In all the 17B05-like sequence described in this paragraph C), the framework sequences may be as further described herein. Preferably, the framework sequences are such that the framework sequences have at least 80%, such as at least 85%, for example at least 90%, such as at least 95% sequence identity with the framework sequences of 17B05 (which, for example, can be determined by determining the overall degree of sequence identity of a given sequence with the sequence of 17B05 while disregarding the CDR's in the calculation). Again, the combination of CDR's and frameworks present in a given sequence are preferably such that the resulting 17B05-like ISV has blocking activity, e.g. block HRG binding to HER3 partially or completely as described above, and/or blocking activity or inhibiting capacity of (trans)phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above.

In one specific aspect, a 17B05-like sequence is an ISV that has at least 70%, such at least 80%, for example at least 85%, such as at least 90% or more than 95% sequence identity with the amino acid sequence 17B05 (SEQ ID NO:

13). For example, in an 17B05-like sequence according to this aspect, the CDR's may be according to the specifically preferred aspect described above, and may in particularly (but without limitation) be LNAMA (CDR1); GIF-GVGSTRYADSVKG (CDR2); and SSVTRGSSDY (CDR3). Again, preferably, the combination of CDR's and frameworks present in such a 17B05-like ISV are preferably such that the resulting 17B05-like ISV has blocking activity, e.g. block HRG binding to HER3 partially or completely as described above, and/or blocking activity or inhibiting capacity of (trans)phosphorylation in a HER3 phosphorylation assay, and/or pAKT phosphorylation assay, and/or ERK1/2 phosphorylation assay and/or has a blocking or inhibiting activity of (hetero)dimerisation as determined by EGFR ligand (EGF) induced HER3 phosphorylation assay, all as described above. In one particular aspect, any 17B05-like sequence may be a humanized and/or sequence optimized sequence, as further described herein.

D) 18G11-like sequences: a "18G11-like sequence", "18G11-like ISV" or "18G11-like building block" is defined as an ISV (as described herein) that comprises:
  a) a CDR1 which comprises or essentially consists of either (i) the amino acid sequence INAMG (SEQ ID NO: 61) or (ii) an amino acid sequence that has only 3, 2 or 1 amino acid difference(s) (as defined herein) with the amino acid sequence INAMG; and/or
  b) a CDR2 which comprises or essentially consists of either (i) the amino acid sequence LITSSDTTDYAESVEG (SEQ ID NO: 91) or (ii) an amino acid sequence that has at least 80%, such as at least 85%, for example at least 90% or more than 95% sequence identity with the amino acid sequence LITSSDTTDYAESVEG; or (iii) an amino acid sequence that has only 7, 6, 5, 4, 3, 2 or 1 amino acid difference(s) (as defined herein) with the amino acid sequence LITSSDTTDYAESVEG; and/or
  c) a CDR3 which comprises or essentially consists of either (i) the amino acid sequence DHYSMGVPEKRVIM (SEQ ID NO: 121) or (ii) an amino acid sequence that has at least 80%, such as at least 85%, for example at least 90% or more than 95% sequence identity with the amino acid sequence DHYSMGVPEKRVIM; or (iii) an amino acid sequence that has only 7, 6, 5, 4, 3, 2 or 1 amino acid difference(s) (as defined herein) with the amino acid sequence DHYSMGVPEKRVIM;

in which the framework sequences present in such an ISV are as further described herein, and in which CDR1, CDR2 and CDR3 are preferably such that the 18G11-like ISV has domain II binding activity, blocking activity or inhibiting capacity of phosphorylation in a HER3 phosphorylation assay and/or pAKT phosphorylation assay, all as described above above.

As mentioned herein, (some of the) 18G11-like sequences may have an effect (which may be limited/partial or more pronounced) on either ligand/HRG binding (in particular, they may to a limited/partial extent be capable of inhibiting or blocking the binding of ligand/HRG to HER3) and/or on the (hetero)dimerization of HER3.

Preferably, in such a 18G11-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 18G11-like sequence, CDR1, CDR2 and CDR3 are all as defined under a), b) and c), respectively. Again, in such an 18G11-like sequence, CDR1, CDR2 and CDR3 are preferably such that the 18G11-like ISV has domain II binding activity, blocking activity or inhibiting capacity of phosphorylation in a HER3 phosphorylation assay and/or pAKT phosphorylation assay, all as described above.

For example, in such an 18G11-like sequence: CDR1 may comprise or essentially consist of the amino acid sequence INAMG (with CDR2 and CDR3 being as defined under b) and c), respectively); and/or CDR2 may comprise or essentially consist of the amino acid sequence LITSSDTTDYAESVEG (with CDR1 and CDR3 being as defined under a) and c), respectively); and/or CDR3 may comprise or essentially consist of the amino acid sequence DHYSMGVPEKRVIM (with CDR1 and CDR2 being as defined under a) and b), respectively). Particularly, when an 18G11-like sequence is according to this aspect: CDR1 may comprise or essentially consist of the amino acid sequence INAMG and CDR2 may comprise or essentially consist of the amino acid sequence LITSSDTTDYAESVEG (with CDR3 being as defined under c) above); and/or CDR1 may comprise or essentially consist of the amino acid sequence INAMG and CDR3 may comprise or essentially consist of the amino acid sequence DHYSMGVPEKRVIM (with CDR2 being as defined under b) above); and/or CDR2 may comprise or essentially consist of the amino acid sequence LITSSDTTDYAESVEG and CDR3 may comprise or essentially consist of the amino acid sequence DHYSMGVPEKRVIM (with CDR1 being as defined under a) above). Again, in such 18G11-like sequences, CDR1, CDR2 and CDR3 are preferably such that the 18G11-like ISV has domain II binding activity, blocking activity or inhibiting capacity of phosphorylation in a HER3 phosphorylation assay and/or pAKT phosphorylation assay, all as described above.

In a specifically preferred aspect, a "18G11-like sequence", "18G11-like ISV" or "18G11-like building block" is an ISV that comprises:
  d) a CDR1 which is either (i) the amino acid sequence INAMG or (ii) an amino acid sequence that has only 3, 2 or 1 amino acid difference(s) (as defined herein) with the amino acid sequence INAMG; and/or
  e) a CDR2 which is either (i) the amino acid sequence LITSSDTTDYAESVEG or (ii) an amino acid sequence that has at least 80%, such as at least 85%, for example at least 90% or more than 95% sequence identity with the amino acid sequence LITSSDTTDYAESVEG; or (iii) an amino acid sequence that has only 7, 6, 5, 4, 3, 2 or 1 amino acid difference(s) (as defined herein) with the amino acid sequence LITSSDTTDYAESVEG; and/or
  f) a CDR3 which is either (i) the amino acid sequence DHYSMGVPEKRVIM or (ii) an amino acid sequence that has at least 80%, such as at least 85%, for example at least 90% or more than 95% sequence identity with the amino acid sequence DHYSMGVPEKRVIM; or (iii) an amino acid sequence that has only 7, 6, 5, 4, 3, 2 or 1 amino acid difference(s) (as defined herein) with the amino acid sequence DHYSMGVPEKRVIM;

in which the framework sequences present in such an ISV are as further described herein, and in which CDR1, CDR2 and CDR3 are preferably such that the 18G11-like ISV has domain II binding activity, blocking activity or inhibiting capacity of phosphorylation in a HER3 phosphorylation assay and/or pAKT phosphorylation assay, all as described above above.

Preferably, in a 18G11-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 18G11-like sequence, CDR1, CDR2 and CDR3 are all as defined under d), e) and f), respectively. Again, in such an 18G11-like sequence, CDR1, CDR2 and CDR3 are preferably such that the 18G11-like ISV has domain II binding activity, blocking activity or inhibiting capacity of phosphorylation in a HER3 phosphorylation assay and/or pAKT phosphorylation assay, all as described above. For example, in a 18G11-like sequence according to this specifically preferred aspect: CDR1 is the amino acid sequence INAMG (with CDR2 and CDR3 being as defined under e) and f), respectively); and/or CDR2 is the amino acid sequence LITSSDTTDYAESVEG (with CDR1 and CDR3 being as defined under d) and f), respectively); and/or CDR3 is the amino acid sequence DHYSMGVPEKRVIM (with CDR1 and CDR2 being as defined under d) and e), respectively). Particularly, when an 18G11-like sequence is according to this aspect: CDR1 is the amino acid sequence INAMG and CDR2 is the amino acid sequence LITSSDTTDYAESVEG (with CDR3 being as defined under f) above); and/or CDR1 is the amino acid sequence INAMG and CDR3 is the amino acid sequence DHYSMGVPEKRVIM (with CDR2 being as defined under e) above); and/or CDR2 is the amino acid sequence LITSSDTTDYAESVEG and CDR3 is DHYSMGVPEKRVIM (with CDR1 being as defined under d) above). Again, in such 18G11-like sequences, CDR1, CDR2 and CDR3 are preferably such that the 18G11-like ISV has domain II binding activity, blocking activity or inhibiting capacity of phosphorylation in a HER3 phosphorylation assay and/or pAKT phosphorylation assay, all as described above.

In a particularly preferred 18G11-like sequence: CDR1 is the amino acid sequence INAMG, CDR2 is the amino acid sequence LITSSDTTDYAESVEG; and CDR3 is the amino acid sequence DHYSMGVPEKRVIM.

In all the 18G11-like sequence described in this paragraph D), the framework sequences may be as further described herein. Preferably, the framework sequences are such that the framework sequences have at least 80%, such as at least 85%, for example at least 90%, such as at least 95% sequence identity with the framework sequences of 18G11 (which, for example, can be determined by determining the overall degree of sequence identity of a given sequence with the sequence of 18G11 while disregarding the CDR's in the calculation). Again, the combination of CDR's and frameworks present in a given sequence are preferably such that the resulting 18G11-like ISV has domain II binding activity, blocking activity or inhibiting capacity of phosphorylation in a HER3 phosphorylation assay and/or pAKT phosphorylation assay, all as described above. In one specific aspect, a 18G11-like sequence is an ISV that has at least 70%, such at least 80%, for example at least 85%, such as at least 90% or more than 95% sequence identity with the amino acid sequence 18G11 (SEQ ID NO: 16). For example, in an 18G11-like sequence according to this aspect, the CDR's may be according to the specifically preferred aspect described above, and may in particularly (but without limitation) be INAMG (CDR1); LITSSDTTDYAESVEG (CDR2); and DHYSMGVPEKRVIM (CDR3). Again, preferably, the combination of CDR's and frameworks present in such a 18G11-like ISV are preferably such that the resulting 18G11-like ISV has domain II binding activity, blocking activity or inhibiting capacity of phosphorylation in a HER3 phosphorylation assay and/or pAKT phosphorylation assay, all as described above.

In one particular aspect, any 18G11-like sequence may be a humanized and/or sequence optimized sequence, as further described herein.

E) 34C07-like sequences: a "34C07-like sequence", "34C07-like ISV" or "34C07-like building block" is defined as an ISV (as described herein) that comprises:
   a) a CDR1 which comprises or essentially consists of either (i) the amino acid sequence INAMA (SEQ ID NO: 63) or (ii) an amino acid sequence that has only 3, 2 or 1 amino acid difference(s) (as defined herein) with the amino acid sequence INAMA; and/or
   b) a CDR2 which comprises or essentially consists of either (i) the amino acid sequence EITAGGSTNYADSVKG (SEQ ID NO: 93) or (ii) an amino acid sequence that has at least 80%, such as at least 85%, for example at least 90% or more than 95% sequence identity with the amino acid sequence EITAGGSTNYADSVKG; or (iii) an amino acid sequence that has only 7, 6, 5, 4, 3, 2 or 1 amino acid difference(s) (as defined herein) with the amino acid sequence EITAGGSTNYADSVKG; and/or
   c) a CDR3 which comprises or essentially consists of either (i) the amino acid sequence DHYTTWDRRSAY (SEQ ID NO: 123) or (ii) an amino acid sequence that has at least 80%, such as at least 85%, for example at least 90% or more than 95% sequence identity with the amino acid sequence DHYTTWDRRSAY; or (iii) an amino acid sequence that has only 7, 6, 5, 4, 3, 2 or 1 amino acid difference(s) (as defined herein) with the amino acid sequence DHYTTWDRRSAY;

in which the framework sequences present in such an ISV are as further described herein, and in which CDR1, CDR2 and CDR3 are preferably such that the 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above.

As mentioned herein, (some of the) 34C07-like sequences may have an effect (which may be limited/partial or more pronounced) on either ligand/HRG binding (in particular, they may to a limited/partial extent be capable of inhibiting or blocking the binding of ligand/HRG to HER3) and/or on the (hetero)dimerization of HER3. In particular, they may to a limited extent be capable of inhibiting ligand/HRG binding to HER3. Preferably, in such a 34C07-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 34C07-like sequence, CDR1, CDR2 and CDR3 are all as defined under a), b) and c), respectively. Again, in such an 34C07-like sequence, CDR1, CDR2 and CDR3 are preferably such that the 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above above.

For example, in such an 34C07-like sequence: CDR1 may comprise or essentially consist of the amino acid sequence INAMA (with CDR2 and CDR3 being as defined under b) and c), respectively); and/or CDR2 may comprise or essentially consist of the amino acid sequence EITAGGSTNYADSVKG (with CDR1 and CDR3 being as defined under a) and c), respectively); and/or CDR3 may comprise or essentially consist of the amino acid sequence DHYTTWDRRSAY (with CDR1 and CDR2 being as defined under a) and b), respectively). Particularly, when an 34C07-like sequence is according to this aspect: CDR1 may comprise or essentially consist of the amino acid sequence INAMA and CDR2 may comprise or essentially consist of the amino acid sequence EITAGGSTNYADSVKG (with CDR3 being as defined under c) above); and/or CDR1 may comprise or essentially consist of the amino acid sequence INAMA and CDR3 may comprise or essentially consist of the amino acid sequence DHYTTWDRRSAY (with CDR2 being as defined under b) above); and/or CDR2 may comprise or essentially consist of the amino acid sequence EITAGGSTNYADSVKG and CDR3 may comprise or essentially consist of the amino acid sequence DHYT-TWDRRSAY (with CDR1 being as defined under a) above). Again, in such 34C07-like sequences, CDR1, CDR2 and CDR3 are preferably such that the 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above.

In a specifically preferred aspect, a "34C07-like sequence", "34C07-like ISV" or "34C07-like building block" is an ISV that comprises:

d) a CDR1 which is either (i) the amino acid sequence INAMA or (ii) an amino acid sequence that has only 3, 2 or 1 amino acid difference(s) (as defined herein) with the amino acid sequence INAMA; and/or e) a CDR2 which is either (i) the amino acid sequence EITAGGSTNYADSVKG or (ii) an amino acid sequence that has at least 80%, such as at least 85%, for example at least 90% or more than 95% sequence identity with the amino acid sequence EITAGGSTNY-ADSVKG; or (iii) an amino acid sequence that has only 7, 6, 5, 4, 3, 2 or 1 amino acid difference(s) (as defined herein) with the amino acid sequence EITAGGSTNY-ADSVKG; and/or f) a CDR3 which is either (i) the amino acid sequence DHYTTWDRRSAY or (ii) an amino acid sequence that has at least 80%, such as at least 85%, for example at least 90% or more than 95% sequence identity with the amino acid sequence DHYTTWDRRSAY; or (iii) an amino acid sequence that has only 7, 6, 5, 4, 3, 2 or 1 amino acid difference(s) (as defined herein) with the amino acid sequence DHYTTWDRRSAY;

in which the framework sequences present in such an ISV are as further described herein, and in which CDR1, CDR2 and CDR3 are preferably such that the 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above.

Preferably, in a 34C07-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 34C07-like sequence, CDR1, CDR2 and CDR3 are all as defined under d), e) and f), respectively. Again, in such an 34C07-like sequence, CDR1, CDR2 and CDR3 are preferably such that the 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above.

For example, in a 34C07-like sequence according to this specifically preferred aspect: CDR1 is the amino acid sequence INAMA (with CDR2 and CDR3 being as defined under d) and f), respectively); and/or CDR2 is the amino acid sequence EITAGGSTNYADSVKG (with CDR1 and CDR3 being as defined under d) and f), respectively); and/or CDR3 is the amino acid sequence DHYTTWDRRSAY (with CDR1 and CDR2 being as defined under d) and e), respectively). Particularly, when an 34C07-like sequence is according to this aspect: CDR1 is the amino acid sequence INAMA and CDR2 is the amino acid sequence EITAGGST-NYADSVKG (with CDR3 being as defined under f) above); and/or CDR1 is the amino acid sequence INAMA and CDR3 is the amino acid sequence DHYTTWDRRSAY (with CDR2 being as defined under e) above); and/or CDR2 is the amino acid sequence EITAGGSTNYADSVKG and CDR3 is DHYTTWDRRSAY (with CDR1 being as defined under d) above). Again, in such 34C07-like sequences, CDR1, CDR2 and CDR3 are preferably such that the 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above.

In a particularly preferred 34C07-like sequence: CDR1 is the amino acid sequence INAMA, CDR2 is the amino acid sequence EITAGGSTNYADSVKG; and CDR3 is the amino acid sequence DHYTTWDRRSAY.

In all the 34C07-like sequence described in this paragraph E), the framework sequences may be as further described herein. Preferably, the framework sequences are such that the framework sequences have at least 80%, such as at least 85%, for example at least 90%, such as at least 95% sequence identity with the framework sequences of 34C07 (which, for example, can be determined by determining the overall degree of sequence identity of a given sequence with the sequence of 34C07 while disregarding the CDR's in the calculation). Again, the combination of CDR's and frameworks present in a given sequence are preferably such that the resulting 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above.

In one specific aspect, a 34C07-like sequence is an ISV that has at least 70%, such at least 80%, for example at least 85%, such as at least 90% or more than 95% sequence identity with the amino acid sequence 34C07 (SEQ ID NO: 18). For example, in an 34C07-like sequence according to this aspect, the CDR's may be according to the specifically preferred aspect described above, and may in particularly (but without limitation) be INAMA (CDR1); EITAGGST-NYADSVKG (CDR2); and DHYTTWDRRSAY (CDR3). Again, preferably, the combination of CDR's and frameworks present in such a 34C07-like ISV are preferably such that the resulting 34C07-like ISV has domain II binding activity, blocking activity or inhibiting capacity of phosphorylation in a HER3 phosphorylation assay, and/or pAKT phosphorylation assay, and/or ERK1/2 phosphorylation assay, all as described above.

In one particular aspect, any 34C07-like sequence may be a humanized and/or sequence optimized sequence, as further described herein.

In one particular aspect, any 34C07-like sequence may be a humanized and/or sequence optimized sequence, as further described herein.

All of the amino acid sequences of the invention as described herein (including those according to specific aspects mentioned herein, such as the aspects mentioned in the preceding paragraph) that can bind to HER3 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, the amino acid sequences and polypeptides of the invention are preferably such that they:
bind to HER3 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to HER3 with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^-$, such as between $10^5$ $M^{-1}s^{-1}$ and $10^7$ $M^{-1}s^{-1}$;
and/or such that they:
bind to HER3 with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is such that it will bind to HER3 with an affinity less than 500 nM, preferably less than 200 nM, more preferably less than 10 nM, such as less than 500 pM.

Some preferred IC50 values for binding of the amino acid sequences or polypeptides of the invention to HER3 will become clear from the further description and examples herein.

For binding to HER3, an amino acid sequence of the invention will usually contain within its amino acid sequence one or more amino acid residues or one or more stretches of amino acid residues (i.e. with each "stretch" comprising two or more amino acid residues that are adjacent to each other or in close proximity to each other, i.e. in the primary or tertiary structure of the amino acid sequence) via which the amino acid sequence of the invention can bind to HER3, which amino acid residues or stretches of amino acid residues thus form the "site" for binding to HER3 (also referred to herein as the "antigen binding site").

The amino acid sequences provided by the invention are preferably in essentially isolated form (as defined herein), or form part of a protein or polypeptide of the invention (as defined herein), which may comprise or essentially consist of one or more amino acid sequences of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than HER3), so as to provide a monovalent, multivalent or multispecific polypeptide of the invention, respectively, all as described herein. Such a protein or polypeptide may also be in essentially isolated form (as defined herein).

The amino acid sequences and polypeptides of the invention as such preferably essentially consist of a single amino acid chain that is not linked via disulphide bridges to any other amino acid sequence or chain (but that may or may not contain one or more intramolecular disulphide bridges. For example, it is known that immunoglobulin single variable domains and/or Nanobodies—as described herein—may sometimes contain a disulphide bridge between CDR3 and CDR1 or FR2). However, it should be noted that one or more amino acid sequences of the invention may be linked to each other and/or to other amino acid sequences (e.g. via disulphide bridges) to provide peptide constructs that may also be useful in the invention (for example Fab' fragments, F(ab')$_2$ fragments, ScFv constructs, "diabodies" and other multispecific constructs. Reference is for example made to the review by Holliger and Hudson, Nat. Biotechnol. 2005 September; 23(9):1126-36).

Generally, when an amino acid sequence of the invention (or a compound, construct or polypeptide comprising the same) is intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences of the invention (as well as compounds, constructs and polypeptides comprising the same) are preferably directed against human HER3; whereas for veterinary purposes, the amino acid sequences and polypeptides of the invention are preferably directed against HER3 from the species to be treated, or at at least cross-reactive with HER3 from the species to be treated.

Furthermore, an amino acid sequence of the invention may optionally, and in addition to the at least one binding site for binding against HER3, contain one or more further binding sites for binding against other antigens, proteins or targets.

The efficacy of the amino acid sequences and polypeptides of the invention, and of compositions comprising the same, can be tested using any suitable in vitro assay, cell-based assay, in vivo assay and/or animal model known per se, or any combination thereof, depending on the specific disease or disorder involved. Suitable assays and animal models will be clear to the skilled person, and for example include [ligand dependent HER3 phosphorylation (Wallasch et. Al. (1995) EMBO J. 14(17): 4267-4275), and xenograft tumor models (Schoeberl et. al. (2009) Sci. Signal. 2(77): ra 31)], as well as the assays and animal models used in the experimental part below and in the prior art cited herein.

Also, according to the invention, amino acid sequences and polypeptides that are directed against HER3 from a first species of warm-blooded animal may or may not show cross-reactivity with HER3 from one or more other species of warm-blooded animal. For example, amino acid sequences and polypeptides directed against human HER3 may or may not show cross reactivity with HER3 from one or more other species of primates (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*)) and/or with HER3 from one or more species of animals that are often used in animal models for diseases (for example mouse, rat, rabbit, pig or dog), and in particular in animal models for diseases and disorders associated with HER3 (such as the species and animal models mentioned herein). In this respect, it will be clear to the skilled person that such cross-reactivity, when present, may have advantages from a drug development point of view, since it allows the amino acid sequences and polypeptides against human HER3 to be tested in such disease models.

More generally, amino acid sequences and polypeptides of the invention that are cross-reactive with HER3 from multiple species of mammal will usually be advantageous for use in veterinary applications, since it will allow the same amino acid sequence or polypeptide to be used across multiple species. Thus, it is also encompassed within the scope of the invention that amino acid sequences and polypeptides directed against HER3 from one species of animal (such as amino acid sequences and polypeptides against human HER3) can be used in the treatment of another species of animal, as long as the use of the amino acid sequences and/or polypeptides provide the desired effects in the species to be treated.

The present invention is in its broadest sense also not particularly limited to or defined by a specific antigenic determinant, epitope, part, domain, subunit or confirmation (where applicable) of HER3 against which the amino acid sequences and polypeptides of the invention are directed. For example, the amino acid sequences and polypeptides may or may not be directed against an "interaction site" (as defined herein). However, it is generally assumed and preferred that the amino acid sequences and polypeptides of the invention are preferably directed against an interaction site (as defined herein), and in particular against Heregulin binding site and/or heterodimerization site (see Hsieh and Moasser, supra). Thus, as further described herein, in one preferred, but non-limiting aspect, the amino acid sequences and polypeptides of the invention are directed against the HER3 ligand binding site and/or against the heterodimerization site of HER3, and are as further defined herein. It is noted that other HER3 ligands have been described besides Heregulin (Sithanandam and Anderson (2008) Cancer Gene Therapy, supra). Thus, in another preferred, but non limiting aspect, the amino acid sequences and polypeptides of the invention are directed against the Heregulin (also referred to herein as "HRG") binding site and/or against the heterodimerization site of HER3. As mentioned above, amino acid sequences of the invention that are directed against the HRG binding site are also referred to herein as "HRG-blocking amino acid sequences", "HRG-blocking building blocks" or, when they are ISV's, "HRG-blocking ISV's". Amino acid sequences of the invention that are directed against the HRG binding site (and that most preferably are also capable of inhibiting or blocking HER3 heterodimerization, as further described herein) are also referred to herein as "dimerisation-blocking amino acid sequences","dimerisation-blocking building blocks" or, when they are ISV's, "dimerisation-blocking ISV's".

As further described herein, a polypeptide of the invention may contain two or more amino acid sequences of the invention that are directed against HER3 and in a preferred aspect contain two different amino acid sequences such as immunoglobulin single variable domains that are directed against HER3. Generally, such polypeptides will bind to HER3 with increased avidity compared to a single amino acid sequence of the invention. Such a polypeptide may for example comprise two amino acid sequences of the invention that are directed against the same antigenic determinant, epitope, part, domain, subunit or confirmation (where applicable) of HER3 (which may or may not be an interaction site); or comprise at least one "first" amino acid sequence of the invention that is directed against a first same antigenic determinant, epitope, part, domain, subunit or confirmation (where applicable) of HER3 (which may e.g. be the Heregulin interaction site); and at least one "second" amino acid sequence of the invention that is directed against a second antigenic determinant, epitope, part, domain, subunit or confirmation (where applicable) different from the first (and which may be e.g. be directed against the heterodimerization site). Preferably, in such "biparatopic" polypeptides of the invention, at least one amino acid sequence of the invention is directed against an interaction site (as defined herein), although the invention in its broadest sense is not limited thereto.

Accordingly, and as further described herein, in one specifically advantageous but non-limiting aspect, the invention makes it possible to provide polypeptides of the invention that are both directed against the HRG binding site and also capable of blocking or inhibiting HER3 heterodimerisation, for example by combining one or more (such as one or two) HRG-blocking building blocks with one or more (such as one or two) dimerisation-blocking building blocks in a single polypeptide of the invention (which may be as further described herein).

Also, when the target (i.e. HER3) is part of a binding pair (for example, a receptor-ligand binding pair), the amino acid sequences and polypeptides may be such that they compete with the cognate binding partner (e.g. the ligand, receptor or other binding partner, as applicable) for binding to the target, and/or such that they (fully or partially) neutralize binding of the binding partner to the target. In this respect, it should again be noted that, as mentioned above, other HER3 ligands have been described besides Heregulin (Sithanandam and Anderson (2008) Cancer Gene Therapy, supra), and the amino acid sequences of the invention may (also) compete with and/or (fully or partially) neutralize binding of such ligands to HER3.

It is also within the scope of the invention that, where applicable, an amino acid sequence of the invention can bind to two or more antigenic determinants, epitopes, parts, domains, subunits or confirmations of HER3. In such a case, the antigenic determinants, epitopes, parts, domains or subunits of HER3 to which the amino acid sequences and/or polypeptides of the invention bind may be essentially the same (for example, if HER3 contains repeated structural motifs or occurs in a multimeric form) or may be different (and in the latter case, the amino acid sequences and polypeptides of the invention may bind to such different antigenic determinants, epitopes, parts, domains, subunits of HER3 with an affinity and/or specificity which may be the same or different). Also, for example, when HER3 exists in an activated conformation and in an inactive conformation, the amino acid sequences and polypeptides of the invention may bind to either one of these confirmation, or may bind to both these confirmations (i.e. with an affinity and/or specificity which may be the same or different). Also, for example, the amino acid sequences and polypeptides of the invention may bind to a conformation of HER3 in which it is bound to a pertinent ligand, may bind to a conformation of HER3 in which it not bound to a pertinent ligand, or may bind to both such conformations (again with an affinity and/or specificity which may be the same or different).

It is also expected that the amino acid sequences and polypeptides of the invention will generally bind to all naturally occurring or synthetic analogs, variants, mutants, alleles, parts and fragments of HER3; or at least to those analogs, variants, mutants, alleles, parts and fragments of HER3 that contain one or more antigenic determinants or epitopes that are essentially the same as the antigenic determinant(s) or epitope(s) to which the amino acid sequences and polypeptides of the invention bind in HER3 (e.g. in wild-type HER3). Again, in such a case, the amino acid sequences and polypeptides of the invention may bind to such analogs, variants, mutants, alleles, parts and fragments with an affinity and/or specificity that are the same as, or that are different from (i.e. higher than or lower than), the affinity and specificity with which the amino acid sequences of the invention bind to (wild-type) HER3. It is also included within the scope of the invention that the amino acid sequences and polypeptides of the invention bind to some analogs, variants, mutants, alleles, parts and fragments of HER3, but not to others.

When HER3 exists in a monomeric form and in one or more multimeric forms, it is within the scope of the invention that the amino acid sequences and polypeptides of the invention only bind to HER3 in monomeric form, only bind to HER3 in multimeric form, or bind to both the monomeric and the multimeric form. Again, in such a case, the amino acid sequences and polypeptides of the invention may bind to the monomeric form with an affinity and/or specificity that are the same as, or that are different from (i.e. higher than or lower than), the affinity and specificity with which the amino acid sequences of the invention bind to the multimeric form.

Also, when HER3 can associate with other proteins or polypeptides to form protein complexes (e.g. with MET, HER1, HER2, or HER4), it is within the scope of the invention that the amino acid sequences and polypeptides of the invention bind to HER3 in its non-associated state, bind to HER3 in its associated state, or bind to both, preferably binds only or preferentially to its non-associated state and prevents in any event heterodimerization at least partially. In all these cases, the amino acid sequences and polypeptides of the invention may bind to such multimers or associated protein complexes with an affinity and/or specificity that may be the same as or different from (i.e. higher than or lower than) the affinity and/or specificity with which the amino acid sequences and polypeptides of the invention bind to HER3 in its monomeric and non-associated state.

Also, as will be clear to the skilled person, proteins or polypeptides that contain two or more amino acid sequences directed against HER3 may bind with higher avidity to HER3 than the corresponding monomeric amino acid sequence(s). For example, and without limitation, proteins or polypeptides that contain two or more amino acid sequences directed against different epitopes of HER3 may (and usually will) bind with higher avidity than each of the different monomers, and proteins or polypeptides that contain two or more amino acid sequences directed against HER3 may (and usually will) bind also with higher avidity to a multimer of HER3.

Generally, amino acid sequences and polypeptides of the invention will at least bind to those forms of HER3 (including monomeric, multimeric and associated forms) that are the most relevant from a biological and/or therapeutic point of view, as will be clear to the skilled person and are in a preferred aspect as described herein.

It is also within the scope of the invention to use parts, fragments, analogs, mutants, variants, alleles and/or derivatives of the amino acid sequences and polypeptides of the invention, and/or to use proteins or polypeptides comprising or essentially consisting of one or more of such parts, fragments, analogs, mutants, variants, alleles and/or derivatives, as long as these are suitable for the uses envisaged herein. Such parts, fragments, analogs, mutants, variants, alleles and/or derivatives will usually contain (at least part of) a functional antigen-binding site for binding against HER3; and more preferably will be capable of specific binding to HER3, and even more preferably capable of binding to HER3 with an affinity (suitably measured and/or expressed as a $K_D$-value (actual or apparent), a $K_A$-value (actual or apparent), a $k_{on}$-rate and/or a $k_{off}$-rate, or alterna- tively as an $IC_{50}$ value, as further described herein) that is as defined herein. Some non-limiting examples of such parts, fragments, analogs, mutants, variants, alleles, derivatives, proteins and/or polypeptides will become clear from the further description herein. Additional fragments or polypeptides of the invention may also be provided by suitably combining (i.e. by linking or genetic fusion) one or more (smaller) parts or fragments as described herein.

In one specific, but non-limiting aspect of the invention, which will be further described herein, such analogs, mutants, variants, alleles, derivatives have an increased half-life in serum (as further described herein) compared to the amino acid sequence from which they have been derived. For example, an amino acid sequence of the invention may be linked (chemically or otherwise) to one or more groups or moieties that extend the half-life (such as PEG), so as to provide a derivative of an amino acid sequence of the invention with increased half-life.

In one specific, but non-limiting aspect, the amino acid sequence of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al., J. (1999) Protein Eng. 12, 563-71. Preferably, when properly folded so as to form an immunoglobulin fold, such an amino acid sequence is capable of specific binding (as defined herein) to HER3; and more preferably capable of binding to HER3 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequences of the invention may be amino acid sequences that essentially consist of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequences of the invention may in particular be an immunoglobulin sequence or a suitable fragment thereof, and more in particular be an immunoglobulin single variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence of the invention is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" from an animal of the family of camelids such as e.g. a llama (as defined herein).

However, it should be noted that the invention is not limited as to the origin of the amino acid sequence of the invention (or of the nucleotide sequence of the invention used to express it), nor as to the way that the amino acid sequence or nucleotide sequence of the invention is (or has been) generated or obtained. Thus, the amino acid sequences of the invention may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or Nanobodies), "camelized" (as defined herein) immunoglobulin sequences, as well as immunoglobulin sequences that have been sequence optimized for optimal expression and/or stability and/or solubility, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequences of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

The amino acid sequence of the invention may in particular be a immunoglobulin singe variable domain (or an immunoglobulin singe variable domain that is suitable for use as an immunoglobulin singe variable domain), a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a Nanobody (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature, 1989 Oct. 12; 341 (6242): 544-6), to Holt et al., Trends Biotechnol., 2003, 21(11):484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be an immunoglobulin singe variable domain or Nanobody (as defined herein) or a suitable fragment thereof. Such Nanobodies directed against HER3 will also be referred to herein as "Nanobodies of the invention".

For a general description of immunoglobulin singe variable domain or Nanobodies (Note: the term "immunoglobulin singe variable domain" and "Nanobodies" are used interchangeably in this application), reference is made to the further description below, as well as to the prior art cited herein. In particular, the term Nanobody is as defined in WO 08/020,079 or WO 09/068,627, and as described therein generally refers to an immunoglobulin heavy chain variable domain that has the functional and/or structural characteristics of a $V_{HH}$ domain (e.g. a $V_H$ domain from the "heavy-chain only" antibodies that occur in Camelids), and as such may in particular be a (native) $V_{HH}$, a humanized $V_{HH}$ or a camelized $V_H$, such as a camelized human $V_H$.

In this respect, it should however be noted that this description and the prior art mainly described Nanobodies of the so-called "$V_H3$ class" (i.e. Nanobodies with a high degree of sequence homology to human germline sequences of the $V_H3$ class such as DP-47, DP-51 or DP-29), which Nanobodies form a preferred aspect of this invention. It should however be noted that the invention in its broadest sense generally covers any type of Nanobody directed against HER3, and for example also covers the Nanobodies belonging to the so-called "$V_H4$ class" (i.e. Nanobodies with a high degree of sequence homology to human germline sequences of the $V_H4$ class such as DP-78), as for example described in WO 07/118,670.

Generally, Nanobodies (in particular $V_{HH}$ sequences and partially humanized Nanobodies) can in particular be characterized by the presence of one or more "Hallmark residues" (as described herein) in one or more of the framework sequences (again as further described herein).

Thus, generally, a Nanobody can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

More in particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) preferably one or more of the amino acid residues at positions 11, 37, 44, 45, 47, 83, 84, 103, 104 and 108 according to the Kabat numbering are chosen from the Hallmark residues mentioned in Table B-2 below. In these Nanobodies, the CDR sequences are generally as further defined herein.

TABLE B-2

Hallmark Residues in Nanobodies

| Position | Human $V_H3$ | Hallmark Residues |
|---|---|---|
| 11 | L, V; predominantly L | L, S, V, M, W, F, T, Q, E, A, R, G, K, Y, N, P, I; preferably L |
| 37 | V, I, F; usually V | $F^{(1)}$, Y, V, L, A, H, S, I, W, C, N, G, D, T, P, preferably $F^{(1)}$ or Y |
| 44[8] | G | $E^{(3)}$, $Q^{(3)}$, $G^{(2)}$, D, A, K, R, L, P, S, V, H, T, N, W, M, I; preferably $G^{(2)}$, $E^{(3)}$ or $Q^{(3)}$; most preferably $G^{(2)}$ or $Q^{(3)}$. |
| 45[8] | L | $L^{(2)}$, $R^{(3)}$, P, H, F, G, Q, S, E, T, Y, C, I, D, V; preferably $L^{(2)}$ or $R^{(3)}$ |
| 47[8] | W, Y | $F^{(1)}$, $L^{(1)}$ or $W^{(2)}$ G, I, S, A, V, M, R, Y, E, P, T, C, H, K, Q, N, D; preferably $W^{(2)}$, $L^{(1)}$ or $F^{(1)}$ |
| 83 | R or K; usually R | R, $K^{(5)}$, T, $E^{(5)}$, Q, N, S, I, V, G, M, L, A, D, Y, H; preferably K or R; most preferably K |
| 84 | A, T, D; predominantly A | $P^{(5)}$, S, H, L, A, V, I, T, F, D, R, Y, N, Q, G, E; preferably P |
| 103 | W | $W^{(4)}$, $R^{(6)}$, G, S, K, A, M, Y, L, F, T, N, V, Q, $P^{(6)}$, E, C; preferably W |

TABLE B-2-continued

Hallmark Residues in Nanobodies

| Position | Human $V_H3$ | Hallmark Residues |
|---|---|---|
| 104 | G | G, A, S, T, D, P, N, E, C, L; preferably G |
| 108 | L, M or T; predominantly L | Q, $L^{(7)}$, R, P, E, K, S, T, M, A, H; preferably Q or $L^{(7)}$ |

Notes:
[1] In particular, but not exclusively, in combination with KERE or KQRE at positions 43-46.
[2] Usually as GLEW at positions 44-47.
[3] Usually as KERE or KQRE at positions 43-46, e.g. as KEREL, KEREF, KQREL, KQREF, KEREG, KQREW or KQREG at positions 43-47. Alternatively, also sequences such as TERE (for example TEREL), TQRE (for example TQREL), KECE (for example KECEL or KECER), KQCE (for example KQCEL), RERE (for example REREG), RQRE (for example RQREL, RQREF or RQREW), QERE (for example QEREG), QQRE, (for example QQREW, QQREL or QQREF), KGRE (for example KGREG), KDRE (for example KDREV) are possible. Some other possible, but less preferred sequences include for example DECKL and NVCEL.
[4] With both GLEW at positions 44-47 and KERE or KQRE at positions 43-46.
[5] Often as KP or EP at positions 83-84 of naturally occurring $V_{HH}$ domains.
[6] In particular, but not exclusively, in combination with GLEW at positions 44-47.
[7] With the proviso that when positions 44-47 are GLEW, position 108 is always Q in (non-humanized) $V_{HH}$ sequences that also contain a W at 103.
[8] The GLEW group also contains GLEW-like sequences at positions 44-47, such as for example GVEW, EPEW, GLER, DQEW, DLEW, GIEW, ELEW, GPEW, EWLP, GPER, GLER and ELEW.

As further described herein, when the ISV's are nanobodies, they may contain framework sequences that are generally as described on pages 258 to 297 of WO 09/068,627 (incorporated herein by reference). Some specific preferred, but non-limiting framework sequences (and preferred combinations of the same) will be clear to the skilled person based on the disclosure herein and for example includes the FR1, FR2, FR3 and FR4 sequences (and combinations thereof) that are present in the Nanobodies listed in Table A-1 (see also Table B-1), or variants thereof with only a limited number (such as less than 5, for example 4, 3, 2 or only 1 per each FR1, FR2, FR3 or FR4) of amino acid differences (as defined in WO 09/068,627 and in WO 08/020,079), which may for example be humanizing substitutions and/or other amino acid differences that have been introduced for the purpose of sequence optimisation (some non-limiting examples of both the former and the latter will be clear to the skilled person based on the disclosure herein and in WO 09/068,627 and in WO 08/020,079).

Thus, the invention also relates to such Nanobodies that can bind to (as defined herein) and/or are directed against HER3, to suitable fragments thereof, as well as to polypeptides that comprise or essentially consist of one or more of such Nanobodies and/or suitable fragments.

SEQ ID NO's: 12 to 26 (see Table A-1) give the amino acid sequences of a number of immunoglobulin single variable domains that have been raised against HER3.

TABLE A-1

Preferred Immunoglobulin single variable domains or Nanobody sequences
(also referred herein as a sequence with a particular name or SEQ ID NO: X, wherein X is a number referring to the relevant amino acid sequence):

| Name | SEQ ID NO: X, wherein X = | Amino acid sequence |
|---|---|---|
| 18F05 | 12 | EVQLVESGGGLVQPGGSLRLSCVASGFTFSSYWMYWVRQAPGK GVEWVSAISPGGVERYTDSVKGRFTISRDNAKNTLYLQMNSLKS EDTAMYYCARLTSFATPESQGTQVTVSS |
| 17B05 | 13 | EVQLVESGGGLVQPGGSLRLSCAASGSIGGLNAMAWYRQAPGK ERELVAGIFGVGSTRYADSVKGRFTISRDIAKNTVFLQMNSLNSE DTAVYYCRMSSVTRGSSDYWGQGTQVTVSS |

TABLE A-1-continued

Preferred Immunoglobulin single variable domains
or Nanobody sequences
(also referred herein as a sequence with a particular
name or SEQ ID NO: X, wherein X is a number
referring to the relevant amino acid sequence):

| Name | SEQ ID NO: X, wherein X = | Amino acid sequence |
|---|---|---|
| 18B05 | 14 | EVQLVESGGGLVQAGGSLRLSCAASGLTFGSAPMGWYRQAPGK ERELVAYISGDERIWYGDSVKGRFTISRDTTKNTLYLQMNSLKPE DTAVYYCVSDVKVRHWGQGTQVTVSS |
| 04C07 | 15 | EVQLVESGGGLVQAGGSLRLSCAASGFTFSSYPMSWVRQAPGK GPAWVSTVSPGGITTSYADSVKGRFTISRDNAKNTLYLQMNSLK PEDTAVYYCLRDLNNRGQGTQVTVSS |
| 18G11 | 16 | EVQLVESGGGLVQPGGSLRLSCAASGTLFKINAMGWYRQAPGK RRELVALITSSDTTDYAESVEGRFTISRDNTWNAVYLQMNSLKP EDTAVYYCHSDHYSMGVPEKRVIMYGQGTQVTVSS |
| 18E08 | 17 | EVQLVESGGGLVQPGGSLRLSCAASGTLFKINAMGWYRQAPGK QRELVALITSSDTTDYAESVEGRFTISRDNTWNAVYLQMNSLKP EDTAVYYCHSDHYSMGVPEKRVIMYGQGTQVTVSS |
| 34C07 | 18 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTQVTVSS |
| 05A09 | 19 | EVQLVESGGGLVQAGGSLRLSCAASGFTFDDYAIGWFRQAPGKE REGVSCISSSDGSTVYADSVKGRFTISSDNAKNTVYLQMNSLKPE DTAVYYCAAERRRGYSDLCRFYYGMDYWGKGTQVTVSS |
| 17C08 | 20 | EVQLVESGGGLMQAGDSLRLSCAASGRAFSSYALGWFRRAPGK ERECVAATDRLGDNTYFPDSVKGRFTISRDNAKNTLYLQMNNL KPEDTAVYYCAAGAVRYGVSTSPMNYNYWGQGTQVTVSS |
| 21B02 | 21 | EVQLVESGGGLVQPGGSLRLSCAASGFTFDYYTIGWFRQAPGKE REGVSCISSRDGDSYYADSVKGRFTISRDNAKNTAYLQMNSLKP EDTAVYYCAASASDYGLGLELFHDEYNYWGQGTQVTVSS |
| 21F06 | 22 | EVQLVESGGGLVQAGGSLRLSCAASGRTYYLNAMGWFRQGPG KDREFVAAIDWSDGNKDYADSVKGRFTISRDNAKNTVYLQMNS LKPEDTAVYYCAADTPPWGPMIYIESYDSWGQGTQVTVSS |
| 23F05 | 23 | EVQLVESGGGLVQAGGSLRLSCAASGFTFDGYAIGWFRQAPGKE REGVSCISGGDGRSYYADSVKGRFTVSSDNAKNTLYLEMNSLKP EDTAVYYCAVIWGPYCSDSYEYLYEYDYWGQGTQVTVSS |
| 34A04 | 24 | EVQLVESGGGLVQAGGSLRLSCAASGFTFDDYTIGWFRQAPGKE REEISCISNNDGSTYYTNSVKGRFTISSDNAKNTVYLQMNSLKPE DTAVYYCAASPHGCWYDLIPLQADFGSWGQGTQVTVSS |
| 17E08 | 25 | EVQLVESGGGLVQPGGSLRLSCSASGSIFGLNAMGWYRQTPGKE RELVAGITSITRVGSTRYADSAKGRFTISGDYAKNTVYLQMNSL KPEDTGVYYCRMSIVKSGGADYWGQGTQVTVSS |
| 04F10 | 26 | EVQLVESGGGLVQPGGSLKLSCVASGSMFRFYHMAWYRQAPGE QRELVARIYTGGDTIYGDSVLGRFTISRDNSKNTVYLQMNTLKPE DTGVYYCNAFREYH IWGQGTQVTVSS |

In particular, the invention in some specific aspects provides:

amino acid sequences that are directed against (as defined herein) HER3 and that have at least 80%, preferably at least 85%, such as 90% or 95% or more sequence identity with at least one of the amino acid sequences of SEQ ID NO's: 12 to 26 (see Table A-1). These amino acid sequences may further be such that they neutralize binding of the cognate ligand to HER3; and/or compete with the cognate ligand for binding to HER3; and/or are directed against the heterodimerization site (as defined herein) on HER3;

amino acid sequences that cross-block (as defined herein) the binding of at least one of the amino acid sequences of SEQ ID NO's: 12 to 26 (see Table A-1) to HER3 and/or that compete with at least one of the amino acid sequences of SEQ ID NO's: 12 to 26 (see Table A-1) for binding to HER3. Again, these amino acid sequences may further be such that they neutralize binding of the cognate ligand to HER3; and/or compete with the cognate ligand for binding to HER3; and/or are directed against the heterodimerization site (as defined herein) on HER3;

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

In some other specific aspects, the invention provides:
amino acid sequences of the invention that are specific for HER3 compared to HER1, HER2 and/or HER4;
which amino acid sequences of the invention may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to HER3 and which:
i) have at least 80% amino acid identity with at least one of the amino acid sequences of SEQ ID NO's: 12 to 26 (see Table A-1), in which for the purposes of determining the degree of amino acid identity, the amino acid residues that form the CDR sequences are disregarded. In this respect, reference is also made to Table B-1, which lists the framework 1 sequences (SEQ ID NO's: 42 to 56), framework 2 sequences (SEQ ID NO's: 72 to 86), framework 3 sequences (SEQ ID NO's: 102 to 116) and framework 4 sequences (SEQ ID NO's: 132 to 146) of the Nanobodies of SEQ ID NO's: 12 to 26 (see Table A-1) (with respect to the amino acid residues at positions 1 to 4 and 27 to 30 of the framework 1 sequences, reference is also made to the comments made below. Thus, for determining the degree of amino acid identity, these residues are preferably disregarded);
and in which:
ii) preferably one or more of the amino acid residues at positions 11, 37, 44, 45, 47, 83, 84, 103, 104 and 108 according to the Kabat numbering are chosen from the Hallmark residues mentioned in Table B-2 supra.

In these Nanobodies, the CDR sequences are generally as further defined herein.

Again, such Nanobodies may be derived in any suitable manner and from any suitable source, and may for example be naturally occurring $V_{HH}$ sequences (i.e. from a suitable species of Camelid) or synthetic or semi-synthetic amino acid sequences, including but not limited to "humanized" (as defined herein) Nanobodies, "camelized" (as defined herein) immunoglobulin sequences (and in particular camelized heavy chain variable domain sequences), as well as Nanobodies that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a Nanobody comprises a $V_{HH}$ sequence, said Nanobody may be suitably humanized, as further described herein, so as to provide one or more further (partially or fully) humanized Nanobodies of the invention.

Similarly, when a Nanobody comprises a synthetic or semi-synthetic sequence (such as a partially humanized sequence), said Nanobody may optionally be further suitably humanized, again as described herein, again so as to provide one or more further (partially or fully) humanized Nanobodies of the invention.

In particular, humanized Nanobodies may be amino acid sequences that are as generally defined for Nanobodies in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Some particularly preferred sequence optimized Nanobodies of the invention are sequence optimized variants of the Nanobodies of SEQ ID NO's: 12 to 26 (see Table A-1) are some especially preferred examples.

Thus, some other preferred Nanobodies of the invention are Nanobodies which can bind (as further defined herein) to HER3 and which:
i) are a humanized variant of one of the amino acid sequences of SEQ ID NO's: 12 to 26 (see Table A-1); and/or
ii) have at least 80% amino acid identity with at least one of the amino acid sequences of SEQ ID NO's: 12 to 26 (see Table A-1), in which for the purposes of determining the degree of amino acid identity, the amino acid residues that form the CDR sequences are disregarded;
and in which:
i) preferably one or more of the amino acid residues at positions 11, 37, 44, 45, 47, 83, 84, 103, 104 and 108 according to the Kabat numbering are chosen from the Hallmark residues mentioned in Table B-2 supra.

According to another specific aspect of the invention, the invention provides a number of stretches of amino acid residues (i.e. small peptides) that are particularly suited for binding to HER3. These stretches of amino acid residues may be present in, and/or may be corporated into, an amino acid sequence of the invention, in particular in such a way that they form (part of) the antigen binding site of an amino acid sequence of the invention. As these stretches of amino acid residues were first generated as CDR sequences of heavy chain antibodies or $V_{HH}$ sequences that were raised against HER3 (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these stretches of amino acid residues may have in an amino acid sequence of the invention, as long as these stretches of amino acid residues allow the amino acid sequence of the invention to bind to HER3. Thus, generally, the invention in its broadest sense comprises any amino acid sequence that is capable of binding to HER3 and that comprises one or more CDR sequences as described herein, and in particular a suitable combination of two or more such CDR sequences, that are suitably linked to each other via one or more further amino acid sequences, such that the entire amino acid sequence forms a binding domain and/or binding unit that is capable of binding to HER3. It should however also be noted that the presence of only one such CDR sequence in an amino acid sequence of the invention may by itself already be sufficient to provide an amino acid sequence of the invention that is capable of binding to HER3; reference is for example again made to the so-called "Expedite fragments" described in WO 03/050531 or WO2009/127691.

Thus, in another specific, but non-limiting aspect, the amino acid sequence of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531 or WO2009/127691). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™) tendamistat, fibronectin, lipocalin, CTLA-4, T-cell receptors, designed ankyrin repeats, avimers and PDZ domains (Binz et al., Nat. Biotech 2005, Vol 23:1257), and binding moieties based on DNA or RNA including but not limited to DNA or RNA aptamers (Ulrich et al., Comb Chem High Throughput Screen 2006 9(8):619-32).

Again, any amino acid sequence of the invention that comprises one or more of these CDR sequences is preferably such that it can specifically bind (as defined herein) to HER3, and more in particular such that it can bind to HER3 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein), that is as defined herein.

More in particular, the amino acid sequences according to this aspect of the invention may be any amino acid sequence that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR1 sequences described herein or the CDR3 sequences described herein.

Even more in particular, the amino acid sequences of the invention may be amino acid sequences that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence directed against HER3, that comprises one or more stretches of amino acid residues chosen from the group consisting of:

a) the amino acid sequences of SEQ ID NO's: 57 to 71;

b) amino acid sequences that have at least 80% amino acid identity with at least one of the amino acid sequences of SEQ ID NO's: 57 to 71;

c) amino acid sequences that have 3, 2, or 1 amino acid difference with at least one of the amino acid sequences of SEQ ID NO's: 57 to 71;

d) the amino acid sequences of SEQ ID NO's: 87 to 101;

e) amino acid sequences that have at least 80% amino acid identity with at least one of the amino acid sequences of SEQ ID NO's: 87 to 101;

f) amino acid sequences that have 3, 2, or 1 amino acid difference with at least one of the amino acid sequences of SEQ ID NO's: 87 to 101;

g) the amino acid sequences of SEQ ID NO's: 117 to 131;

h) amino acid sequences that have at least 80% amino acid identity with at least one of the amino acid sequences of SEQ ID NO's: 117 to 131;

i) amino acid sequences that have 3, 2, or 1 amino acid difference with at least one of the amino acid sequences of SEQ ID NO's: 117 to 131;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:

i) the amino acid sequences of SEQ ID NO's: 57 to 71;
ii) the amino acid sequences of SEQ ID NO's: 87 to 101; and
iii) the amino acid sequences of SEQ ID NO's: 117 to 131;
or any suitable combination thereof.

Also, preferably, in such an amino acid sequence, at least one of said stretches of amino acid residues forms part of the antigen binding site for binding against HER3.

In a more specific, but again non-limiting aspect, the invention relates to an amino acid sequence directed against HER3, that comprises two or more stretches of amino acid residues chosen from the group consisting of:
a) the amino acid sequences of SEQ ID NO's: 57 to 71;
b) amino acid sequences that have at least 80% amino acid identity with at least one of the amino acid sequences of SEQ ID NO's: 57 to 71;
c) amino acid sequences that have 3, 2, or 1 amino acid difference with at least one of the amino acid sequences of SEQ ID NO's: 57 to 71;
d) the amino acid sequences of SEQ ID NO's: 87 to 101;
e) amino acid sequences that have at least 80% amino acid identity with at least one of the amino acid sequences of SEQ ID NO's: 87 to 101;
amino acid sequences that have 3, 2, or 1 amino acid difference with at least one of the amino acid sequences of SEQ ID NO's: 87 to 101;
g) the amino acid sequences of SEQ ID NO's: 117 to 131;
h) amino acid sequences that have at least 80% amino acid identity with at least one of the amino acid sequences of SEQ ID NO's: 117 to 131;
i) amino acid sequences that have 3, 2, or 1 amino acid difference with at least one of the amino acid sequences of SEQ ID NO's: 117 to 131;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 57 to 71;
ii) the amino acid sequences of SEQ ID NO's: 87 to 101; and
iii) the amino acid sequences of SEQ ID NO's: 117 to 131;
such that, (i) when the first stretch of amino acid residues corresponds to one of the amino acid sequences of SEQ ID NO's: 57 to 71, the second stretch of amino acid residues corresponds to one of the amino acid sequences of SEQ ID NO's: 87 to 101 or of SEQ ID NO's: 117 to 131; (ii) when the first stretch of amino acid residues corresponds to one of the amino acid sequences of SEQ ID NO's: 87 to 101, the second stretch of amino acid residues corresponds to one of the amino acid sequences of SEQ ID NO's: 57 to 71 or of SEQ ID NO's: 117 to 131; or (iii) when the first stretch of amino acid residues corresponds to one of the amino acid sequences of SEQ ID NO's: 117 to 131, the second stretch of amino acid residues corresponds to one of the amino acid sequences of SEQ ID NO's: 57 to 71 or of SEQ ID NO's: 87 to 101.

Also, in such an amino acid sequence, the at least two stretches of amino acid residues again preferably form part of the antigen binding site for binding against HER3.

In an even more specific, but non-limiting aspect, the invention relates to an amino acid sequence directed against HER3, that comprises three or more stretches of amino acid residues, in which the first stretch of amino acid residues is chosen from the group consisting of:
a) the amino acid sequences of SEQ ID NO's: 57 to 71;
b) amino acid sequences that have at least 80% amino acid identity with at least one of the amino acid sequences of SEQ ID NO's: 57 to 71;
c) amino acid sequences that have 3, 2, or 1 amino acid difference with at least one of the amino acid sequences of SEQ ID NO's: 57 to 71;
the second stretch of amino acid residues is chosen from the group consisting of:
d) the amino acid sequences of SEQ ID NO's: 87 to 101;
e) amino acid sequences that have at least 80% amino acid identity with at least one of the amino acid sequences of SEQ ID NO's: 87 to 101;
f) amino acid sequences that have 3, 2, or 1 amino acid difference with at least one of the amino acid sequences of SEQ ID NO's: 87 to 101;
and the third stretch of amino acid residues is chosen from the group consisting of:
g) the amino acid sequences of SEQ ID NO's: 117 to 131;
h) amino acid sequences that have at least 80% amino acid identity with at least one of the amino acid sequences of SEQ ID NO's: 117 to 131;
i) amino acid sequences that have 3, 2, or 1 amino acid difference with at least one of the amino acid sequences of SEQ ID NO's: 117 to 131.

Preferably, in this specific aspect, the first stretch of amino acid residues is chosen from the group consisting of the amino acid sequences of SEQ ID NO's: 57 to 71; the second stretch of amino acid residues is chosen from the group consisting of the amino acid sequences of SEQ ID NO's: 87 to 101; and the third stretch of amino acid residues is chosen from the group consisting of the amino acid sequences of SEQ ID NO's: 117 to 131.

Again, preferably, in such an amino acid sequence, the at least three stretches of amino acid residues forms part of the antigen binding site for binding against HER3.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 12 to 26 (see Table A-1). This degree of amino acid identity can for example be determined by determining the degree of amino acid identity (in a manner described herein) between said amino acid sequence and one or more of the sequences of SEQ ID NO's: 12 to 26 (see Table A-1), in which the amino acid residues that form the framework regions are disregarded. Also, such amino acid sequences of the invention can be as further described herein.

Also, such amino acid sequences are preferably such that they can specifically bind (as defined herein) to HER3; and more in particular bind to HER3 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 57 to 71;
b) amino acid sequences that have at least 80% amino acid identity with at least one of the amino acid sequences of SEQ ID NO's: 57 to 71;
c) amino acid sequences that have 3, 2, or 1 amino acid difference with at least one of the amino acid sequences of SEQ ID NO's: 57 to 71;
and/or
CDR2 is chosen from the group consisting of:
d) the amino acid sequences of SEQ ID NO's: 87 to 101;
e) amino acid sequences that have at least 80% amino acid identity with at least one of the amino acid sequences of SEQ ID NO's: 87 to 101;
f) amino acid sequences that have 3, 2, or 1 amino acid difference with at least one of the amino acid sequences of SEQ ID NO's: 87 to 101;
and/or
CDR3 is chosen from the group consisting of:
g) the amino acid sequences of SEQ ID NO's: 117 to 131;
h) amino acid sequences that have at least 80% amino acid identity with at least one of the amino acid sequences of SEQ ID NO's: 117 to 131;
i) amino acid sequences that have 3, 2, or 1 amino acid difference with at least one of the amino acid sequences of SEQ ID NO's: 117 to 131.

In particular, such an amino acid sequence of the invention may be such that CDR1 is chosen from the group consisting of the amino acid sequences of SEQ ID NO's: 57 to 71; and/or CDR2 is chosen from the group consisting of the amino acid sequences of SEQ ID NO's: 87 to 101; and/or CDR3 is chosen from the group consisting of the amino acid sequences of SEQ ID NO's: 117 to 131.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 57 to 71;
b) amino acid sequences that have at least 80% amino acid identity with at least one of the amino acid sequences of SEQ ID NO's: 57 to 71;
c) amino acid sequences that have 3, 2, or 1 amino acid difference with at least one of the amino acid sequences of SEQ ID NO's: 57 to 71;
and
CDR2 is chosen from the group consisting of:
d) the amino acid sequences of SEQ ID NO's: 87 to 101;
e) amino acid sequences that have at least 80% amino acid identity with at least one of the amino acid sequences of SEQ ID NO's: 87 to 101;

f) amino acid sequences that have 3, 2, or 1 amino acid difference with at least one of the amino acid sequences of SEQ ID NO's: 87 to 101;
and
CDR3 is chosen from the group consisting of:
g) the amino acid sequences of SEQ ID NO's: 117 to 131;
h) amino acid sequences that have at least 80% amino acid identity with at least one of the amino acid sequences of SEQ ID NO's: 117 to 131;
i) amino acid sequences that have 3, 2, or 1 amino acid difference with at least one of the amino acid sequences of SEQ ID NO's: 117 to 131; or any suitable fragment of such an amino acid sequence In particular, such an amino acid sequence of the invention may be such that CDR1 is chosen from the group consisting of the amino acid sequences of SEQ ID NO's: 57 to 71; and CDR2 is chosen from the group consisting of the amino acid sequences of SEQ ID NO's: 87 to 101; and CDR3 is chosen from the group consisting of the amino acid sequences of SEQ ID NO's: 117 to 131.

Again, preferred combinations of CDR sequences will become clear from the further description herein.

Also, such amino acid sequences are preferably such that they can specifically bind (as defined herein) to HER3; and more in particular bind to HER3 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 12 to 26 (see Table A-1). This degree of amino acid identity can for example be determined by determining the degree of amino acid identity (in a manner described herein) between said amino acid sequence and one or more of the sequences of SEQ ID NO's: 12 to 26 (see Table A-1), in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_H$-sequence). In one particularly preferred aspect, the framework sequences are either framework sequences that have been derived from a $V_{HH}$-sequence (in which said framework sequences may optionally have been partially or fully humanized) or are conventional $V_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a Nanobody (including but not limited to $V_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a Nanobody. Some preferred, but non-limiting examples of (suitable combinations of) such framework sequences will become clear from the further disclosure herein.

In particular, when the ISV's of the invention are nNnobodies (as described herein) the framework sequences present therein may be as generally described on pages 258 to 297 of WO 09/068,627 (incorporated herein by reference). For example, they may contain one or more of the combinations of Hallmark residues set out in Table A-5 of WO 09/068,627; and FR1, FR2, FR3 and FR4 may contain the amino acid residues set out in Table A-6, Table A-7, Table A-8 and Table A-9 of WO 09/068,627, respectively. Also, when the ISV's of the invention are Nanobodies, they may belong to the KERE-group (see pages 281 to 284 of WO 09/068,627, with some representative FR1, FR2, FR3 and FR4 sequences for this group given in Tables A-11/A-15, A-12, A-13 and A-14 of WO 09/068,627); to the GLEW-group (see pages 285 to 287 of WO 09/068,627, with some representative FR1, FR2, FR3 and FR4 sequences for this group given in Tables A-16/A-20, A-17, A-18 and A-19 of WO 09/068,627); or to the P, R, S 103 group (see pages 287 to 291 of WO 09/068,627, with some representative FR1, FR2, FR3 and FR4 sequences for this group given in Tables A-21/A-25, A-22, A-23 and A-24 of WO 09/068,627), which are all as described in WO 09/068,627, with some representative sequences for each of these groups given in Table A-10 of 09/068627. As also described in WO 09/068,627, these framework sequences may contain one or more suitable humanizing substitutions or (other) substitutions for optimizing the sequence (see also the further disclosure herein).

Again, some particularly preferred but non-limiting FR1, FR2, FR3 and FR4 sequences (and combinations thereof) are those described in Table B-1, or suitable variants of such FR1, FR2, FR3 and FR4 sequences, respectively (for example, with less than 6, such as 1, 2, 3, 4 or 5 suitable amino acid differences in such an FR1, FR2, FR3 or FR4 compared to a framework sequence mentioned in Table B-1, in which the amino acid differences may be as described in WO 09/068,627) that still essentially retain the desired properties of Nanobodies.

Again, as generally described herein for the amino acid sequences of the invention, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived). Such fragments may also again be such that they comprise or can form an immunoglobulin fold, or alternatively be such that they do not comprise or cannot form an immunoglobulin fold.

In one specific aspect, such a fragment comprises a single CDR sequence as described herein (and in particular a CDR3 sequence), that is flanked on each side by (part of) a framework sequence (and in particular, part of the framework sequence(s) that, in the immunoglobulin sequence from which the fragment is derived, are adjacent to said CDR sequence. For example, a CDR3 sequence may be preceded by (part of) a FR3 sequence and followed by (part of) a FR4 sequence). Such a fragment may also contain a disulphide bridge, and in particular a disulphide bridge that links the two framework regions that precede and follow the CDR sequence, respectively (for the purpose of forming such a disulphide bridge, cysteine residues that naturally occur in said framework regions may be used, or alternatively cysteine residues may be synthetically added to or introduced into said framework regions).

In another aspect, the invention relates to a compound or construct, and in particular a protein or polypeptide (also referred to herein as a "compound of the invention" or "polypeptide of the invention", respectively) that comprises or essentially consists of one or more amino acid sequences of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence of the invention (and/or to the compound or construct in which it is present) and may or may not modify the properties of the amino acid sequence of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences, and in particular ISV's. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

For example, such one or more (such as one or two) further ISV that are present in a polypeptide of the invention (i.e. in addition to the one or more ISV's against HER3) may be directed against another target than HER3 so as to provide a "bispecific" protein or polypeptide of the invention (i.e. a polypeptide of the invention that contains at least one—such as one or two—immunoglobulin single variable domain that is directed against HER3 and at least one—such as one or two—immunoglobulin single variable domain that is directed against another target).

For example, according to a specific but non-limiting aspect, the amino acid sequences, constructs, proteins or polypeptides of the invention may have been provided with an increased half-life (as defined herein, and compared with the same construct but without the modifications made to provide for the increased half-life, for example without the functionalisation/pegylation or without the serum-albumin binding peptide or binding domain/ISV), for example by suitable functionalisation (such as pegylation) and/or by including in the construct a moiety or binding unit that increases the half-life of the construct. Examples of such functionalisation, moieties or binding units will be clear to the skilled person and may for example include pegylation, fusion to serum albumin, or fusion to a peptide or binding unit that can bind to a serum protein such as serum albumin.

In the latter constructs (i.e. fusion constructs comprising at least one—such as one or two—amino acid sequence of the invention and at least one—such as one or two—peptide or binding unit that can bind to a serum protein such as serum albumin), the serum-albumin binding peptide or binding domain may be any suitable serum-albumin binding peptide or binding domain capable of increasing the half-life of the construct (compared to the same construct without the serum-albumin binding peptide or binding domain), and may in particular be serum albumin binding peptides as described in WO 2008/068280 by applicant (and in particular WO 2009/127691 and the non-prepublished U.S. application 61/301,819, both by applicant), or a serum—albumin binding immunoglobulin single variable domain (such as a serum-albumin binding Nanobody; for example Alb-1 or a humanized version of Alb-1 such as Alb-8 (also referred to herein as Alb-11 or ALB11), for which reference is for example made to WO 06/122787).

With respect to half-life, it should be noted that in the invention, and by using the various half-life extending techniques described herein (for example, by suitably choosing a serum-albumin binding peptide according to WO 2008/068280, WO 2009/127691 and/or the non-prepublished U.S. application 61/301,819), the half-life of a construct or polypeptide of the invention can (and preferably is) suitably "tailored" for the intended (therapeutic and/or diagnostic) application and/or to obtain the best balance between the desired therapeutic and/or pharmacological effect and possible undesired side-effects.

Thus, for example, and without limitation, a preferred aspect of the invention provides a "bispecific" polypeptide consisting essentially of one immunoglobulin single variable domain directed against human HER3 (or, alternatively, of two immunoglobulin single variable domains directed against human HER3, which may be the same or different, i.e. so as to provide—when they are the same or different—a "bivalent" polypeptide of the invention, or—when they are different—"biparatopic" polypeptide of the invention) and one immunoglobulin single variable domain directed against human serum albumin linked by a peptide linker (as defined herein), so as to provide a bispecific polypeptide of the invention, respectively, all as described herein. Such a protein or polypeptide may also be in essentially isolated form (as defined herein).

In another specific, but non-limiting aspect, an amino acid sequence (such as a Nanobody) of the invention or a polypeptide of the invention (such as a bivalent, biparatopic or bispecific polypeptide of the invention) may be suitably linked (again, chemically or via one or more suitable linkers or spacers) to a toxin or to a (cyto)toxic residue, moiety or payload. Examples of suitable (cyto)toxic moieties, compounds, payloads or residues which can be linked to amino acids sequences or polypeptides of the invention to provide—for example—a cytotoxic compound (i.e. an antibody-drug conjugate or "ADC" based upon an amino acid sequence or polypeptide of the invention) will be clear to the skilled person. Reference is for example made to the review by Ducry and Stump, Bioconjugate Chem., 2010, 21 (1), pp 5-13. Such cytotoxic amino acid sequences or polypeptides of the invention may in particular be useful/suitable for those applications in which it is intended to kill a cell that expresses the target against which the amino acid sequences or polypeptides of the invention are directed (e.g. in the treatment of cancer), or to reduce or slow the growth and/or proliferation such a cell. Usually, but without limitation, (cyto)toxic polypeptides of the invention will either not be half-life extended or will have only a limited and/or tightly controlled half-life extension.

Alternatively, such one or more further groups, residues, moieties or binding units that may be present in a polypeptide of the invention may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivatives as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more amino acid sequences of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

As will be clear from the further description above and herein, this means that the amino acid sequences of the invention can be used as "building blocks" to form polypeptides of the invention, i.e. by suitably combining them with other groups, residues, moieties or binding units, in order to form compounds or constructs as described herein (such as, without limitations, the biparatopic, bi/multivalent and bi/multispecific polypeptides of the invention described herein) which combine within one molecule one or more desired properties or biological functions.

Some specific examples of polypeptides of the invention are polypeptides that comprise or essentially consist of:

two amino acid sequences (and in particular and preferably ISV's) directed against HER3, which may be the same or different, suitably linked either directly or using one or more suitable linkers or spacers (as described herein);

two HRG-blocking amino acid sequences (as defined herein, and which may be different but which are preferably the same), and in particular and preferably two HRG-blocking ISV's (as defined herein, which again may be different but which are preferably the same), suitably linked either directly or using one or more suitable linkers or spacers (as described herein);

two dimerisation-blocking amino acid sequences (as defined herein, and which may be different but which are preferably the same), and in particular and preferably two dimerisation-blocking ISV's (as defined herein, which again may be different but which are preferably the same), suitably linked either directly or using one or more suitable linkers or spacers (as described herein);

two domain II-binding amino acid sequences (as defined herein, and which may be different but which are preferably the same), and in particular and preferably two domain II-binding ISV's (as defined herein, which again may be different but which are preferably the same), suitably linked either directly or using one or more suitable linkers or spacers (as described herein);

one HRG-blocking amino acid sequence (as defined herein, and in particular and preferably one HRG-blocking ISV, also as defined herein) and one other amino acid sequence (and in particular and preferably one other ISV) that is directed against HER3 (as defined herein) and that is not a HRG-blocking amino acid sequence (or ISV), suitably linked either directly or using one or more suitable linkers or spacers (as described herein);

one dimerisation-blocking amino acid sequence (as defined herein, and in particular and preferably one dimerisation-blocking ISV, also as defined herein) and one other amino acid sequence (and in particular and preferably one other ISV) that is directed against HER3 (as defined herein) and that is not a dimerisation-blocking amino acid sequence (or ISV), suitably linked either directly or using one or more suitable linkers or spacers (as described herein);

one domain II-binding amino acid sequence (as defined herein, and in particular and preferably one domain II-binding ISV, also as defined herein) and one other amino acid sequence (and in particular and preferably one other ISV) that is directed against HER3 (as defined herein) and that is not a domain II-binding amino acid sequence (or ISV), suitably linked either directly or using one or more suitable linkers or spacers (as described herein);

one HRG-blocking amino acid sequence (as defined herein, and in particular and preferably one HRG-blocking ISV, also as defined herein) and one dimerisation-blocking amino acid sequence (as defined herein, and in particular and preferably one dimerisation-blocking ISV, also as defined herein), suitably linked either directly or using one or more suitable linkers or spacers (as described herein);

one HRG-blocking amino acid sequence (as defined herein, and in particular and preferably one HRG-blocking ISV, also as defined herein) and one domain II-binding amino acid sequence (as defined herein, and in particular and preferably one domain II-binding ISV, also as defined herein), suitably linked either directly or using one or more suitable linkers or spacers (as described herein);

one dimerisation-blocking amino acid sequence (as defined herein, and in particular and preferably one dimerisation-blocking ISV, also as defined herein) and one domain II-binding amino acid sequence (as defined herein, and in particular and preferably one domain II-binding ISV, also as defined herein), suitably linked either directly or using one or more suitable linkers or spacers (as described herein);

and such polypeptides (of which some non-limiting examples will be clear to the skilled person based on the disclosure herein) form further aspects of the invention.

Also, as mentioned the amino acid sequences and polypeptides of the invention (such as the polypeptides described above) may be half-life extended, for example by suitable functionalisation and/or by including in the construct a moiety or binding unit that increases the half-life of the construct. Where the half-life of an amino acid sequence or polypeptide is extended by fusion to a peptide or binding unit that can bind to a serum protein such as serum albumin, the resulting construct/polypeptide of the invention may for example and without limitation comprise or essentially consist of:

- one amino acid sequence (and in particular and preferably ISV) directed against HER3 and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- one HRG-blocking amino acid sequence (as defined herein), and in particular and preferably one HRG-blocking ISV (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- one dimerisation-blocking amino acid sequence (as defined herein), and in particular and preferably one dimerisation-blocking ISV (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- one domain II-binding amino acid sequence (as defined herein), and in particular and preferably one domain II-binding ISV (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- two amino acid sequences (and in particular and preferably ISV's) directed against HER3, which may be the same or different, and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- two HRG-blocking amino acid sequences (as defined herein, and which may be different but which are preferably the same), and in particular and preferably two HRG-blocking ISV's (as defined herein, which again may be different but which are preferably the same), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- two dimerisation-blocking amino acid sequences (as defined herein, and which may be different but which are preferably the same), and in particular and preferably two dimerisation-blocking ISV's (as defined herein, which again may be different but which are preferably the same), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- two domain II-binding amino acid sequences (as defined herein, and which may be different but which are preferably the same), and in particular and preferably two domain II-binding ISV's (as defined herein, which again may be different but which are preferably the same), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- one HRG-blocking amino acid sequence (as defined herein, and in particular and preferably one HRG-blocking ISV, also as defined herein) and one other amino acid sequence (and in particular and preferably one other ISV) that is directed against HER3 (as defined herein) and that is not a HRG-blocking amino acid sequence (or ISV), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- one dimerisation-blocking amino acid sequence (as defined herein, and in particular and preferably one dimerisation-blocking ISV, also as defined herein) and one other amino acid sequence (and in particular and preferably one other ISV) that is directed against HER3 (as defined herein) and that is not a dimerisation-blocking amino acid sequence (or ISV), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- one domain II-binding amino acid sequence (as defined herein, and in particular and preferably one domain II-binding ISV, also as defined herein) and one other amino acid sequence (and in particular and preferably one other ISV) that is directed against HER3 (as defined herein) and that is not a domain II-binding amino acid sequence (or ISV), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);
- one HRG-blocking amino acid sequence (as defined herein, and in particular and preferably one HRG-blocking ISV, also as defined herein) and one dimerisation-blocking amino acid sequence (as defined herein, and in particular and preferably one dimerisation-blocking ISV, also as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one HRG-blocking amino acid sequence (as defined herein, and in particular and preferably one HRG-blocking ISV, also as defined herein) and one domain II-binding amino acid sequence (as defined herein, and in particular and preferably one domain II-binding ISV, also as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one dimerisation-blocking amino acid sequence (as defined herein, and in particular and preferably one dimerisation-blocking ISV, also as defined herein) and one domain II-binding amino acid sequence (as defined herein, and in particular and preferably one domain II-binding ISV, also as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

and such polypeptides (of which some non-limiting examples will be clear to the skilled person based on the disclosure herein—for example, some are listed in Table A-2 below) also form further aspects of the invention.

Of these, particularly preferred are polypeptides of the invention that either:

a) comprise or essentially consist of one HRG-blocking amino acid sequence (as defined herein, and in particular and preferably one HRG-blocking ISV, also as defined herein) and one dimerisation-blocking amino acid sequence (as defined herein, and in particular and preferably one dimerisation-blocking ISV, also as defined herein), and that optionally further comprise a group, residue, moiety or binding unit that increases the half-life of said amino acid sequence (and preferably an ISV that is directed to a serum protein and in particular to serum albumin such as Alb-8/Alb-11, or a peptide that is directed to a serum protein and in particular to serum albumin), suitably linked either directly or using one or more suitable linkers or spacers (as described herein). Such polypeptides may, for example and without limitation, comprise one 17B05-like sequence, one 21F06-like sequence, and a serum albumin binding ISV such as Alb-8, optionally suitably linked to each other via one or more suitable spacers or linkers. A specific preferred but non-limiting example of such polypeptide is HER3MS00135 (SEQ ID NO:282); or that b) comprise or essentially consist of one dimerisation-blocking amino acid sequence (as defined herein, and in particular and preferably one dimerisation-blocking ISV, also as defined herein) and one domain II-binding amino acid sequence (as defined herein, and in particular and preferably one domain II-binding ISV, also as defined herein), and a group, residue, moiety or binding unit that increases the half-life of said amino acid sequence (and preferably an ISV that is directed to a serum protein and in particular to serum albumin such as Alb-8/Alb-11, or a peptide that is directed to a serum protein and in particular to serum albumin), suitably linked either directly or using one or more suitable linkers or spacers (as described herein). Such polypeptides may, for example and without limitation, comprise one 17B05-like sequence, one 18G11-like sequence, and a serum albumin binding ISV such as Alb-8, optionally suitably linked to each other via one or more suitable spacers or linkers. Two specific preferred, but non-limiting examples of such a polypeptide are HER3MS00212 (SEQ ID NO:319) and HER3MS00215 (SEQ ID NO:322).

As also already mentioned herein, when one of the above polypeptides: (i) contains an HRG-blocking amino acid sequence, it is preferably either a 21F06-like sequence (as defined herein) or a 04C07-like sequence (also as defined herein); and/or (ii) contains a dimerisation-blocking sequence, it is preferably a 17B05-like sequence (as defined herein); and/or (iii) contains a domain II-binding sequence, it is preferably either a 18G11-like sequence or a 34C07-like sequence. Some specific examples of such polypeptides of the invention are polypeptides that comprise or essentially consist of:

two 21F06-like sequences (as defined herein, and which may be the same or different), suitably linked either directly or using one or more suitable linkers or spacers (as described herein);

two 04C07-like sequences (as defined herein, and which may be the same or different), suitably linked either directly or using one or more suitable linkers or spacers (as described herein);

two 17B05-like sequences (as defined herein, and which may be the same or different), suitably linked either directly or using one or more suitable linkers or spacers (as described herein);

two 18G11-like sequences (as defined herein, and which may be the same or different), suitably linked either directly or using one or more suitable linkers or spacers (as described herein);

two 34C07-like sequences (as defined herein, and which may be the same or different), suitably linked either directly or using one or more suitable linkers or spacers (as described herein);

one 21F06-like sequence (as defined herein) and one 04C07-like sequence (as defined herein), suitably linked either directly or using one or more suitable linkers or spacers (as described herein);

one 21F06-like sequence (as defined herein) and one 17B05-like sequence (as defined herein), suitably linked either directly or using one or more suitable linkers or spacers (as described herein);

one 21F06-like sequence (as defined herein) and one 18G11-like sequence (as defined herein), suitably linked either directly or using one or more suitable linkers or spacers (as described herein);

one 21F06-like sequence (as defined herein) and one 34C07-like sequence (as defined herein), suitably linked either directly or using one or more suitable linkers or spacers (as described herein);

one 04C07-like sequence (as defined herein) and one 17B05-like sequence (as defined herein), suitably linked either directly or using one or more suitable linkers or spacers (as described herein);

one 04C07-like sequence (as defined herein) and one 18G11-like sequence (as defined herein), suitably linked either directly or using one or more suitable linkers or spacers (as described herein);

one 04C07-like sequence (as defined herein) and one 34C07-like sequence (as defined herein), suitably linked either directly or using one or more suitable linkers or spacers (as described herein);

one 17B05-like sequence (as defined herein) and one 18G11-like sequence (as defined herein), suitably linked either directly or using one or more suitable linkers or spacers (as described herein);

one 17B05-like sequence (as defined herein) and one 34C07-like sequence (as defined herein), suitably linked either directly or using one or more suitable linkers or spacers (as described herein);

one 18G11-like sequence (as defined herein) and one 34C07-like sequence (as defined herein), suitably linked either directly or using one or more suitable linkers or spacers (as described herein);

and such polypeptides (of which some non-limiting examples will be clear to the skilled person based on the disclosure herein—for example, some are listed in Table A-2 below) again form further aspects of the invention.

Also, again, such polypeptides may be half-life extended, i.e. for example by suitable functionalisation and/or by including in the construct a moiety or binding unit that increases the half-life of the construct. Where the half-life of an amino acid sequence or polypeptide is extended by fusion to a peptide or binding unit that can bind to a serum protein such as serum albumin, the resulting construct/polypeptide of the invention may for example and without limitation comprise or essentially consist of:

two 21F06-like sequences (as defined herein, and which may be the same or different), suitably linked either directly or using one or more suitable linkers or spacers (as described herein);

two 04C07-like sequences (as defined herein, and which may be the same or different), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

two 17B05-like sequences (as defined herein, and which may be the same or different), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

two 18G11-like sequences (as defined herein, and which may be the same or different), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

two 34C07-like sequences (as defined herein, and which may be the same or different), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 21F06-like sequence (as defined herein) and one 04C07-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 21F06-like sequence (as defined herein) and one 17B05-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 21F06-like sequence (as defined herein) and one 18G11-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 21F06-like sequence (as defined herein) and one 34C07-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 04C07-like sequence (as defined herein) and one 17B05-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 04C07-like sequence (as defined herein) and one 18G11-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 04C07-like sequence (as defined herein) and one 34C07-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 17B05-like sequence (as defined herein) and one 18G11-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 17B05-like sequence (as defined herein) and one 34C07-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

one 18G11-like sequence (as defined herein) and one 34C07-like sequence (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), suitably linked either directly or using one or more suitable linkers or spacers (as described herein);

and again such polypeptides (of which some non-limiting examples will be clear to the skilled person based on the disclosure herein—for example, some are listed in Table A-2 below) again form further aspects of the invention.

Some specifically preferred, but non-limiting polypeptides of the invention comprise or essentially consist of:

a) one 21F06-like sequence (as defined herein) and one 17B05-like sequence (as defined herein), and group, residue, moiety or binding unit that increases the half-life of said amino acid sequence (and preferably an ISV that is directed to a serum protein and in particular to serum albumin such as Alb-8, or a peptide that is directed to a serum protein and in particular to serum albumin), suitably linked either directly or using one or more suitable linkers or spacers (as described herein). A specific preferred but non-limiting example of such polypeptide is HER3MS00135 (SEQ ID NO:282); or b) one 17B05-like sequence (as defined herein) and one 18G11-like sequence (as defined herein), and a group, residue, moiety or binding unit that increases the half-life of said amino acid sequence (and preferably an ISV that is directed to a serum protein and in particular to serum albumin such as Alb-8, or a peptide that is directed to a serum protein and in particular to serum albumin), suitably linked either directly or using one or more suitable linkers or spacers (as described herein). Two specific preferred, but non-limiting examples of such a polypeptide are HER3MS00212 (SEQ ID NO:319) and HER3MS00215 (SEQ ID NO:322).

Some specifically preferred, but non-limiting examples of polypeptides of the invention are HER3MS00135 (SEQ ID NO:282), HER3MS00212 (SEQ ID NO:319) and HER3MS00212 (SEQ ID NO:322). The invention thus also relates to:

a) the polypeptide HER3MS00135 (SEQ ID NO:282), as well as to polypeptides that have at least 80%, such as at least 85%, for example at least 90%, and up to 95% or more (such as 98%, 99% or more) sequence identity with HER3MS00135 (SEQ ID NO:282), in which the 21F06-like sequence and 17B05-like sequence present in such polypeptides are preferably as described herein;

b) the polypeptide HER3MS00212 (SEQ ID NO:319), as well as to polypeptides that have at least 80%, such as at least 85%, for example at least 90%, and up to 95% or more (such as 98%, 99% or more) sequence identity with HER3MS00212 (SEQ ID NO:319), in which the 18G11-like sequence and 17B05-like sequence present in such polypeptides are preferably as described herein;

c) the polypeptide HER3MS00215 (SEQ ID NO:322), as well as to polypeptides that have at least 80%, such as at least 85%, for example at least 90%, and up to 95% or more (such as 98%, 99% or more) sequence identity with HER3MS00215 (SEQ ID NO:322), in which the 18G11-like sequence and 17B05-like sequence present in such polypeptides are preferably as described herein.

It has also been found that some of the polypeptides provided by the invention may have an effect on HER3 internalization, and in particular may increase internalisation of the HER3 receptor. This may for example have the effect of reducing the number of HER3 receptors present on the surface of a cell, and thus reducing the ligand-sensitivity of the cell and/or reducing the HER3 mediated signalling in/by said cell and/or modulating other HER3 related biological effects of said cell. Reference is for instance made to Example 17 below. This effect on HER3 internalisation shown by the polypeptides of the invention is particularly surprising because so far, none of the corresponding monovalent building blocks present in said internalisation-promoting polypeptides have been found to have a similar influence on HER3 internalisation.

It will be clear to the skilled person that for some applications of the polypeptides of the invention, it may be advantageous to use a polypeptide of the invention that can promote or increase HER3 internalisation of a HER3 expressing cell that is exposed to or contacted with such a polypeptide (for example, after administration of said polypeptide to a patient or other subject). Thus, in one aspect, a polypeptide as described herein (which may contain any of the building blocks/ISV's described herein and which may for example be any of the polypeptides described on the previous pages) is preferably such that it is capable of promoting or increasing HER3 internalisation of a cell, for example by at least 5%, such as at least 10%, for example at least 25%, such as 50% or even 90% or more, as measured using a suitable assay, for example the assay of Examples 17 and 20.

It will also be clear to the skilled person that for other applications of the polypeptides of the invention, it may be advantageous to use a polypeptide of the invention that essentially does not alter, promote or increase HER3 internalisation of a HER3 expressing cell that is exposed to or contacted with such a polypeptide (for example, after administration of said polypeptide to a patient or other subject). Thus, in one aspect, a polypeptide as described herein (which may contain any of the building blocks/ISV's described herein and which may for example be any of the polypeptides described on the previous pages) is preferably such that is does not alter or affect HER3 internalisation of a cell, as measured using a suitable assay, for example the assay of Examples 17 and 20.

The compounds or polypeptides of the invention can generally be prepared by a method which comprises at least one step of suitably linking the one or more amino acid sequences of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence of the invention, is also referred to herein as "formatting" said amino acid sequence of the invention; and an amino acid of the invention that is made part of a compound or polypeptide of the invention is said to be "formatted" or to be "in the format of" said compound or polypeptide of the invention. Examples of ways in which an amino acid sequence of the invention can be formatted and examples of such formats will be clear to the skilled person based on the disclosure herein; and such formatted amino acid sequences form a further aspect of the invention.

In one specific aspect of the invention, a compound of the invention or a polypeptide of the invention may have an increased half-life, compared to the corresponding amino acid sequence of the invention. Some preferred, but non-limiting examples of such compounds and polypeptides will become clear to the skilled person based on the further disclosure herein, and for example comprise amino acid sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one amino acid sequence of the invention that is linked to at least one moiety (and in particular at least one amino acid sequence) that increases the half-life of the amino acid sequence of the invention. Examples of polypeptides of the invention that comprise such half-life extending moieties or amino acid sequences will become clear to the skilled person based on the further disclosure herein; and for example include, without limitation, polypeptides in which the one or more amino acid sequences of the invention are suitable linked to one or more serum proteins or fragments thereof (such as (human) serum albumin or suitable fragments thereof) or to one or more binding units that can bind to serum proteins (such as, for example, domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum proteins such as serum albumin (such as human serum albumin), serum immunoglobulins such as IgG, or transferrine; reference is made to the further description and references mentioned herein); polypeptides in which an amino acid sequence of the invention is linked to an Fc portion (such as a human Fc) or a suitable part or fragment thereof; or polypeptides in which the one or more amino acid sequences of the invention are suitable linked to one or more small proteins or peptides that can bind to serum proteins (such as, without limitation, the proteins and peptides described in WO 91/01743, WO 01/45746, WO 02/076489 and to the US provisional application of Ablynx N.V. entitled "Peptides capable of binding to serum proteins" of Ablynx N.V. filed on Dec. 5, 2006 (see also PCT/EP2007/063348).

Generally, the compounds or polypeptides of the invention with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the compounds or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se. In a preferred, but non-limiting aspect of the invention, above increases in half-life are achieved in mammals such as e.g. human, i.e. preferably in humans.

In a preferred, but non-limiting aspect of the invention, such compounds or polypeptides of the invention have a serum half-life that is increased with more than 1 hours, preferably more than 2 hours, more preferably more than 6 hours, such as more than 12 hours, or even more than 24, 48 or 72 hours, compared to the corresponding amino acid sequence of the invention per se. In a preferred, but non-limiting aspect of the invention, above increases in half-life are achieved in mammals such as e.g. human, i.e. preferably in humans.

In another preferred, but non-limiting aspect of the invention, such compounds or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days). In a preferred, but non-limiting aspect of the invention, above serum half-lifes are achieved in mammals such as e.g. human, i.e. preferably in humans.

In another aspect, the invention relates to a nucleic acid that encodes an amino acid sequence of the invention or a polypeptide of the invention (or a suitable fragment thereof). Such a nucleic acid will also be referred to herein as a "nucleic acid of the invention" and may for example be in the form of a genetic construct, as further described herein.

In another aspect, the invention relates to a host or host cell that expresses (or that under suitable circumstances is capable of expressing) an amino acid sequence of the invention and/or a polypeptide of the invention; and/or that contains a nucleic acid of the invention. Some preferred but non-limiting examples of such hosts or host cells will become clear from the further description herein.

The invention further relates to a product or composition containing or comprising at least one amino acid sequence of the invention, at least one polypeptide of the invention (or a suitable fragment thereof) and/or at least one nucleic acid of the invention, and optionally one or more further components of such compositions known per se, e.g. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention also relates to the use of an amino acid sequence, Nanobody or polypeptide of the invention, or of a composition comprising the same, in (methods or compositions for) modulating HER3, either in vitro (e.g. in an in vitro or cellular assay) or in vivo (e.g. in an a single cell or in a multicellular organism, and in particular in a mammal, and more in particular in a human being, such as in a human being that is at risk of or suffers from a variety of cancers).

The invention also relates to methods for modulating HER3, either in vitro (e.g. in an in vitro or cellular assay) or in vivo (e.g. in an a single cell or multicellular organism, and in particular in a mammal, and more in particular in a human being, such as in a human being that is at risk of or suffers from a variety of cancers), which method comprises at least the step of contacting HER3 with at least one amino acid sequence, ISV, Nanobody or polypeptide of the invention, or with a composition comprising the same, in a manner and in an amount suitable to modulate HER3, with at least one amino acid sequence, ISV, Nanobody or polypeptide of the invention.

The invention also relates to the use of an one amino acid sequence, ISV, Nanobody or polypeptide of the invention in the preparation of a composition (such as, without limitation, a pharmaceutical composition or preparation as further described herein) for modulating HER3, either in vitro (e.g. in an in vitro or cellular assay) or in vivo (e.g. in an a single cell or multicellular organism, and in particular in a mammal, and more in particular in a human being, such as in a human being that is at risk of or suffers from a variety of cancers).

In the context of the present invention, "modulating" or "to modulate" generally means either reducing or inhibiting the activity of, or alternatively increasing the activity of, HER3, as measured using a suitable in vitro, cellular or in vivo assay (such as those mentioned herein). In particular, "modulating" or "to modulate" may mean either reducing or inhibiting the activity of, or alternatively increasing the activity of HER3, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to activity of HER3 in the same assay under the same conditions but without the presence of the amino acid sequence, ISV, Nanobody or polypeptide of the invention.

As will be clear to the skilled person, "modulating" may also involve effecting a change (which may either be an increase or a decrease) in affinity, avidity, specificity and/or selectivity of HER3 for one or more of its targets, heterodimerization partners, ligands or substrates; and/or effecting a change (which may either be an increase or a decrease) in the sensitivity of HER3 for one or more conditions in the medium or surroundings in which HER3 is present (such as pH, ion strength, the presence of co-factors, etc.), compared to the same conditions but without the presence of the amino acid sequence, ISV, Nanobody or polypeptide of the invention. As will be clear to the skilled person, this may again be determined in any suitable manner and/or using any suitable assay known per se, such as the assays described herein or in the prior art cited herein.

"Modulating" may also mean effecting a change (i.e. an activity as an agonist or as an antagonist, respectively) with respect to one or more biological or physiological mechanisms, effects, responses, functions, pathways or activities in which HER3 (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in in vivo assay) assay known per se, such as the assays described herein or in the prior art cited herein. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the amino acid sequence, ISV, Nanobody or polypeptide of the invention.

Modulating may for example involve reducing or inhibiting the binding of HER3 to one of its substrates or ligands and/or competing with a natural ligand, substrate for binding to HER3. Modulating may also involve activating HER3 or the mechanism or pathway in which it is involved. Modulating may be reversible or irreversible, but for pharmaceutical and pharmacological purposes will usually be in a reversible manner.

The invention further relates to methods for preparing or generating the amino acid sequences, polypeptides, nucleic acids, host cells, products and compositions described herein. Some preferred but non-limiting examples of such methods will become clear from the further description herein.

Generally, these methods may comprise the steps of:
a) providing a set, collection or library of amino acid sequences; and
b) screening said set, collection or library of amino acid sequences for amino acid sequences that can bind to and/or have affinity for HER3;
and
c) isolating the amino acid sequence(s) that can bind to and/or have affinity for HER3.

In such a method, the set, collection or library of amino acid sequences may be any suitable set, collection or library of amino acid sequences. For example, the set, collection or library of amino acid sequences may be a set, collection or library of immunoglobulin sequences (as described herein), such as a naïve set, collection or library of immunoglobulin sequences; a synthetic or semi-synthetic set, collection or library of immunoglobulin sequences; and/or a set, collection or library of immunoglobulin sequences that have been subjected to affinity maturation.

Also, in such a method, the set, collection or library of amino acid sequences may be a set, collection or library of heavy chain variable domains (such as $V_H$ domains or $V_{HH}$ domains) or of light chain variable domains. For example, the set, collection or library of amino acid sequences may be a set, collection or library of domain antibodies or single domain antibodies, or may be a set, collection or library of amino acid sequences that are capable of functioning as a domain antibody or single domain antibody.

In a preferred aspect of this method, the set, collection or library of amino acid sequences may be an immune set, collection or library of immunoglobulin sequences, for example derived from a mammal that has been suitably immunized with HER3 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating amino acid sequences comprises at least the steps of:
a) providing a collection or sample of cells expressing amino acid sequences;
b) screening said collection or sample of cells for cells that express an amino acid sequence that can bind to and/or have affinity for HER3;
and
c) either (i) isolating said amino acid sequence; or (ii) isolating from said cell a nucleic acid sequence that encodes said amino acid sequence, followed by expressing said amino acid sequence.

For example, when the desired amino acid sequence is an immunoglobulin sequence, the collection or sample of cells may for example be a collection or sample of B-cells. Also, in this method, the sample of cells may be derived from a mammal that has been suitably immunized with HER3 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820 (2001).

In another aspect, the method for generating an amino acid sequence directed against HER3 may comprise at least the steps of:
a) providing a set, collection or library of nucleic acid sequences encoding amino acid sequences;
b) screening said set, collection or library of nucleic acid sequences for nucleic acid sequences that encode an amino acid sequence that can bind to and/or has affinity for HER3;
and
c) isolating said nucleic acid sequence, followed by expressing said amino acid sequence.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with HER3 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating an amino acid sequence directed against HER3 may comprise at least the steps of:
a) providing a set, collection or library of nucleic acid sequences encoding amino acid sequences;
b) screening said set, collection or library of nucleic acid sequences for nucleic acid sequences that encode an amino acid sequence that can bind to and/or has affinity for HER3 and that is cross-blocked or is cross blocking a ISV or Nanobody of the invention, e.g. SEQ ID NO: 12 to 26 (Table A-1), or a humanized ISV or Nanobody of the invention; and
c) isolating said nucleic acid sequence, followed by expressing said amino acid sequence.

The invention also relates to amino acid sequences that are obtained by the above methods, or alternatively by a method that comprises the one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

Also, following the steps above, one or more amino acid sequences of the invention may be suitably humanized (or alternatively camelized); and/or the amino acid sequence(s) thus obtained may be linked to each other or to one or more other suitable amino acid sequences (optionally via one or more suitable linkers) so as to provide a polypeptide of the invention. Also, a nucleic acid sequence encoding an amino acid sequence of the invention may be suitably humanized (or alternatively camelized) and suitably expressed; and/or one or more nucleic acid sequences encoding an amino acid sequence of the invention may be linked to each other or to one or more nucleic acid sequences that encode other suitable amino acid sequences (optionally via nucleotide sequences that encode one or more suitable linkers), after which the nucleotide sequence thus obtained may be suitably expressed so as to provide a polypeptide of the invention.

The invention further relates to applications and uses of the amino acid sequences, compounds, constructs, polypeptides, nucleic acids, host cells, products and compositions described herein, as well as to methods for the prevention and/or treatment for diseases and disorders associated with HER3. Some preferred but non-limiting applications and uses will become clear from the further description herein.

The invention also relates to the amino acid sequences, compounds, constructs, polypeptides, nucleic acids, host cells, products and compositions described herein for use in therapy.

In particular, the invention also relates to the amino acid sequences, compounds, constructs, polypeptides, nucleic acids, host cells, products and compositions described herein for use in therapy of a disease or disorder that can be prevented or treated by administering, to a subject in need thereof, of (a pharmaceutically effective amount of) an amino acid sequence, compound, construct or polypeptide as described herein.

More in particular, the invention relates to the amino acid sequences, compounds, constructs, polypeptides, nucleic acids, host cells, products and compositions described herein for use in therapy of variety of cancers.

Other aspects, embodiments, advantages and applications of the invention will also become clear from the further description herein, in which the invention will be described and discussed in more detail with reference to the Nanobodies of the invention and polypeptides of the invention comprising the same, which form some of the preferred aspects of the invention.

As will become clear from the further description herein, Nanobodies generally offer certain advantages (outlined herein) compared to "dAb's" or similar (single) domain antibodies or immunoglobulin sequences, which advantages are also provided by the Nanobodies of the invention. However, it will be clear to the skilled person that the more general aspects of the teaching below can also be applied (either directly or analogously) to other amino acid sequences of the invention.

DETAILED DESCRIPTION OF THE INVENTION

In the present description, examples and claims:
a) Unless indicated or defined otherwise, all terms used have their usual meaning in the art, which will be clear to the skilled person. Reference is for example made to the standard handbooks mentioned in paragraph a) on page 46 of WO 08/020,079.
b) Unless indicated otherwise, the term "immunoglobulin single variable domain" is used as a general term to include but not limited to antigen-binding domains or fragments such as $V_{HH}$ domains or $V_H$ or $V_L$ domains, respectively, as e.g. herein described. The terms antigen-binding molecules or antigen-binding protein are used interchangeably and include also the term nanobodies. The immunoglobulin single variable domains further are light chain variable domain sequences (e.g. a $V_L$-sequence), or heavy chain variable domain sequences (e.g. a $V_H$-sequence); more specifically, they can be heavy chain variable domain sequences that are derived from a conventional four-chain antibody or heavy chain variable domain sequences that are derived from a heavy chain antibody. Accordingly, the immunoglobulin single variable domains can be domain antibodies, or immunoglobulin sequences that are suitable for use as domain antibodies, single domain antibodies, or immunoglobulin sequences that are suitable for use as single domain antibodies, "dAbs", or immunoglobulin sequences that are suitable for use as dAbs, or nanobodies, or immunoglobulin sequences that are suitable for use as nanobodies, including but not limited to $V_{HH}$ sequences. The invention includes immunoglobulin sequences of different origin, comprising mouse, rat, rabbit, donkey, shark, human and camelid immunoglobulin sequences. The immunoglobulin single variable domain includes fully human, humanized, otherwise sequence optimized or chimeric immunoglobulin sequences. The immunoglobulin single variable domain and structure of an immunoglobulin single variable domain can be considered—without however being limited thereto—to be comprised of four framework regions or "FR's", which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. It is noted that the terms nanobody or nanobodies are registered trademarks of Ablynx N.V. and thus may also be referred to as Nanobody® and/or Nanobodies®).
c) Unless indicated otherwise, the terms "immunoglobulin sequence", "sequence", "nucleotide sequence" and "nucleic acid" are as described in paragraph b) on page 46 of WO 08/020,079.
d) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein; as well as to for example the following reviews Presta, Adv. Drug Deliv. Rev. 2006, 58 (5-6): 640-56; Levin and Weiss, Mol. Biosyst. 2006, 2(1): 49-57; Irving et al., J. Immunol. Methods, 2001, 248(1-2), 31-45; Schmitz et al., Placenta, 2000, 21 Suppl. A, S106-12, Gonzales et al., Tumour Biol., 2005, 26(1), 31-43, which describe techniques for protein engineering, such as affinity maturation and other techniques for improving the specificity and other desired properties of proteins such as immunoglobulins.
e) Amino acid residues will be indicated according to the standard three-letter or one-letter amino acid code. Reference is made to Table A-2 on page 48 of the International application WO 08/020,079 of Ablynx N.V. entitled "Amino acid sequences directed against IL-6R and polypeptides comprising the same for the treatment of diseases and disorders associated with Il-6 mediated signalling".
f) For the purposes of comparing two or more nucleotide sequences, the percentage of "sequence identity" between a first nucleotide sequence and a second nucleotide sequence may be calculated or determined as described in paragraph e) on page 49 of WO 08/020,079 (incorporated herein by reference), such as by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position); or using a suitable computer algorithm or technique, again as described in paragraph e) on pages 49 of WO 08/020,079 (incorporated herein by reference).

g) For the purposes of comparing two or more amino acid sequences, the percentage of "sequence identity" between a first amino acid sequence and a second amino acid sequence (also referred to herein as "amino acid identity") may be calculated or determined as described in paragraph 0 on pages 49 and 50 of WO 08/020,079 (incorporated herein by reference), such as by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein; or using a suitable computer algorithm or technique, again as described in paragraph f) on pages 49 and 50 of WO 08/020,079 (incorporated herein by reference).

Also, in determining the degree of sequence identity between two amino acid sequences, the skilled person may take into account so-called "conservative" amino acid substitutions, as described on page 50 of WO 08/020,079.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Nad. Acad. Sci. USA 81: 140-144, 1984; Kyte & Doolittle; J. Molec. Biol. 157: 105-132, 1981, and Goldman et al., Ann. Rev. Biophys. Chem. 15: 321-353, 1986, all incorporated herein in their entirety by reference. Information on the primary, secondary and tertiary structure of Nanobodies is given in the description herein and in the general background art cited above. Also, for this purpose, the crystal structure of a $V_{HH}$ domain from a llama is for example given by Desmyter et al., Nature Structural Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

h) Amino acid sequences and nucleic acid sequences are said to be "exactly the same" if they have 100% sequence identity (as defined herein) over their entire length.

i) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences.

j) When a nucleotide sequence or amino acid sequence is said to "comprise" another nucleotide sequence or amino acid sequence, respectively, or to "essentially consist of" another nucleotide sequence or amino acid sequence, this has the meaning given in paragraph i) on pages 51-52 of WO 08/020,079.

k) The term "in essentially isolated form" has the meaning given to it in paragraph j) on pages 52 and 53 of WO 08/020,079.

l) The terms "domain" and "binding domain" have the meanings given to it in paragraph k) on page 53 of WO 08/020,079.

m) The terms "antigenic determinant" and "epitope", which may also be used interchangeably herein, have the meanings given to it in paragraph 1) on page 53 of WO 08/020,079.

n) As further described in paragraph m) on page 53 of WO 08/020,079, an amino acid sequence (such as a Nanobody, an antibody, a polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein.

o) The term "specificity" has the meaning given to it in paragraph n) on pages 53-56 of WO 08/020,079; and as mentioned therein refers to the number of different types of antigens or antigenic determinants to which a particular antigen-binding molecule or antigen-binding protein (such as a Nanobody or a polypeptide of the invention) molecule can bind. The specificity of an antigen-binding protein can be determined based on affinity and/or avidity, as described on pages 53-56 of WO 08/020,079 (incorporated herein by reference), which also describes some preferred techniques for measuring binding between an antigen-binding molecule (such as a Nanobody or polypeptide of the invention) and the pertinent antigen. Typically, antigen-binding proteins (such as the amino acid sequences, Nanobodies and/or polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4$ $M^{-1}$) liters/mol is generally considered to indicate non-specific binding. Preferably, a monovalent immunoglobulin sequence of the invention will bind to the desired antigen with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein. As will be clear to the skilled person, and as described on pages 53-56 of WO 08/020,079, the dissociation constant may be the actual or apparent dissociation constant. Methods for determining the dissociation constant will be clear to the skilled person, and for example include the techniques mentioned on pages 53-56 of WO 08/020,079.

p) The half-life of an amino acid sequence, compound or polypeptide of the invention can generally be defined as described in paragraph o) on page 57 of WO 08/020,079 and as mentioned therein refers to the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally be as described in paragraph o) on page 57 of WO 08/020,079. As also mentioned in paragraph o) on page 57 of WO 08/020,079, the half-life can be expressed using parameters such as the t1/2-alpha, t1/2-beta and the area under the curve (AUC). Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982). The terms "increase in half-life" or "increased half-life" as also as defined in paragraph o) on page 57 of WO 08/020,079 and in particular refer to an increase in the t1/2-beta, either with or without an increase in the t1/2-alpha and/or the AUC or both.

q) In the context of the present invention, "modulating" or "to modulate" generally means either reducing or inhibiting the activity of, or alternatively increasing the activity of, a target or antigen, as measured using a suitable in vitro, cellular or in vivo assay. In particular, "modulating" or "to modulate" may mean either reducing or inhibiting the activity of, or alternatively increasing a (relevant or intended) biological activity of, a target or antigen, as measured using a suitable in vitro, cellular or in vivo assay (which will usually depend on the target or antigen involved), by at least 1%, preferably at least 5%, such as at least 10% or at least 25%, for example by at least 50%, at least 60%, at least 70%, at least 80%, or 90% or more, compared to activity of the target or antigen in the same assay under the same conditions but without the presence of the construct of the invention.

As will be clear to the skilled person, "modulating" may also involve effecting a change (which may either be an increase or a decrease) in affinity, avidity, specificity and/or selectivity of a target or antigen for one or more of its ligands, binding partners, partners for association into a homomultimeric or heteromultimeric form, or substrates; and/or effecting a change (which may either be an increase or a decrease) in the sensitivity of the target or antigen for one or more conditions in the medium or surroundings in which the target or antigen is present (such as pH, ion strength, the presence of co-factors, etc.), compared to the same conditions but without the presence of the construct of the invention. As will be clear to the skilled person, this may again be determined in any suitable manner and/or using any suitable assay known per se, depending on the target or antigen involved.

"Modulating" may also mean effecting a change (i.e. an activity as an agonist, as an antagonist or as a reverse agonist, respectively, depending on the target or antigen and the desired biological or physiological effect) with respect to one or more biological or physiological mechanisms, effects, responses, functions, pathways or activities in which the target or antigen (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, depending on the target or antigen involved. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the construct of the invention.

Modulating may for example also involve allosteric modulation of the target or antigen; and/or reducing or inhibiting the binding of the target or antigen to one of its substrates or ligands and/or competing with a natural ligand, substrate for binding to the target or antigen. Modulating may also involve activating the target or antigen or the mechanism or pathway in which it is involved. Modulating may for example also involve effecting a change in respect of the folding or confirmation of the target or antigen, or in respect of the ability of the target or antigen to fold, to change its confirmation (for example, upon binding of a ligand), to associate with other (sub)units, or to disassociate.

Modulating may for example also involve effecting a change in the ability of the target or antigen to transport other compounds or to serve as a channel for other compounds (such as ions).

Modulating may be reversible or irreversible, but for pharmaceutical and pharmacological purposes will usually be in a reversible manner.

r) In respect of a target or antigen, the term "interaction site" on the target or antigen means a site, epitope, antigenic determinant, part, domain or stretch of amino acid residues on the target or antigen that is a site for binding to a ligand, receptor or other binding partner, a catalytic site, a cleavage site, a site for allosteric interaction, a site involved in multimerisation (such as homomerization or heterodimerization and is in particular heterodimerization) of the target or antigen; or any other site, epitope, antigenic determinant, part, domain or stretch of amino acid residues on the target or antigen that is involved in a biological action or mechanism of the target or antigen. More generally, an "interaction site" can be any site, epitope, antigenic determinant, part, domain or stretch of amino acid residues on the target or antigen to which an amino acid sequence or polypeptide of the invention can bind such that the target or antigen (and/or any pathway, interaction, signalling, biological mechanism or biological effect in which the target or antigen is involved) is modulated (as defined herein).

s) An amino acid sequence or polypeptide is said to be "specific for" a first target or antigen compared to a second target or antigen when is binds to the first antigen with an affinity (as described above, and suitably expressed as a $K_D$ value, $K_A$ value, $K_{off}$ rate and/or $K_{on}$ rate) that is at least 10 times, such as at least 100 times, and preferably at least 1000 times, and up to 10.000 times or more better than the affinity with which said amino acid sequence or polypeptide binds to the second target or polypeptide. For example, the first antigen may bind to the target or antigen with a $K_D$ value that is at least 10 times less, such as at least 100 times less, and preferably at least 1000 times less, such as 10.000 times less or even less than that, than the $K_D$ with which said amino acid sequence or polypeptide binds to the second target or polypeptide. Preferably, when an amino acid sequence or polypeptide is "specific for" a first target or antigen compared to a second target or antigen, it is directed against (as defined herein) said first target or antigen, but not directed against said second target or antigen.

t) The terms "cross-block", "cross-blocked" and "cross-blocking" are used interchangeably herein to mean the ability of an immunoglobulin single variable domain or polypeptide to interfere with the binding directly or indirectly through allosteric modulation of other immunoglobulin single variable domains or polypeptides of the invention to a given target. The extend to which an immunoglobulin single variable domain or polypeptide of the invention is able to interfere with the binding of another to the target, and therefore whether it can be said to cross-block according to the invention, can be determined using competition binding assays. One particularly suitable quantitative cross-blocking assay uses a FACS- or an AlphaScreen-based approach to measure competition between the labelled (e.g. His tagged, biotinylated or radioactive labelled) immunoglobulin single variable domain or polypeptide according to the invention and the other binding agent in terms of their binding to the target. The experimental part generally describes suitable FACS-based assays for determining whether a binding molecule cross-blocks or is capable of cross-blocking an immunoglobulin single variable domain or polypeptide according to the invention. It will be appreciated that the assay can be used with any of the immunoglobulin single variable domains or other binding agents described herein. Thus, in general, a cross-blocking amino acid sequence or other binding agent according to the invention is for example one which will bind to the target in the above cross-blocking assay such that, during the assay and in the presence of a second amino acid sequence or other binding agent of the invention, the recorded displacement of the immunoglobulin single variable domain or polypeptide according to the invention is up to 100% (e.g. in FACS based competition assay) of the maximum theoretical displacement (e.g. displacement by cold (e.g. unlabeled) immunoglobulin single variable domain or polypeptide that needs to be cross-blocked) by the to be tested potentially cross-blocking agent that is present in an amount of 0.4 mM or less (cross-blocking agent may be another conventional monoclonal antibody such as IgG, classic monovalent antibody fragments (Fab, scFv)) and/ or variants (including but not limited to wildtype or engineered diabodies, triabodies, minibodies, VHHs, dAbs, VHs, VLs). Preferred, in a non-limiting aspect, immunoglobulin single variable domains or polypeptides of the invention, have a recorded displacement (as described above) that is between 10% and 100%, more preferably between 50% to 100%.

u) An amino acid sequence is said to be "cross-reactive" for two different antigens or antigenic determinants (such as serum albumin from two different species of mammal, such as human serum albumin and cyno serum albumin) if it is specific for (as defined herein) both these different antigens or antigenic determinants.

v) As further described herein, the total number of amino acid residues in a Nanobody can be in the region of 110-130. It should however be noted that parts, fragments, analogs or derivatives (as further described herein) of a Nanobody are not particularly limited as to their length and/or size, as long as such parts, fragments, analogs or derivatives meet the further requirements outlined herein and are also preferably suitable for the purposes described herein;

w) As further described in paragraph q) on pages 58 and 59 of WO 08/020,079 (incorporated herein by reference), the amino acid residues of a Nanobody are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2): 185-195 (see for example FIG. 2 of this publication), and accordingly FR1 of a Nanobody comprises the amino acid residues at positions 1-30, CDR1 of a Nanobody comprises the amino acid residues at positions 31-35, FR2 of a Nanobody comprises the amino acids at positions 36-49, CDR2 of a Nanobody comprises the amino acid residues at positions 50-65, FR3 of a Nanobody comprises the amino acid residues at positions 66-94, CDR3 of a Nanobody comprises the amino acid residues at positions 95-102, and FR4 of a Nanobody comprises the amino acid residues at positions 103-113.

x) The Figures, Sequence Listing and the Experimental Part/Examples are only given to further illustrate the invention and should not be interpreted or construed as limiting the scope of the invention and/or of the appended claims in any way, unless explicitly indicated otherwise herein.

For a general description of heavy chain antibodies and the variable domains thereof, reference is inter alia made to the prior art cited herein, as well as to the prior art mentioned on page 59 of WO 08/020,079 and to the list of references mentioned on pages 41-43 of the International application WO 06/040153, which prior art and references are incorporated herein by reference.

In accordance with the terminology used in the art (see the above references), the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as Nanobodies based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and Nanobodies can function as a single, relatively small, functional antigen-binding structural unit, domain or protein. This distinguishes the $V_{HH}$ domains from the $V_H$ and $V_L$ domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and ISV's or Nanobodies as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or F(ab')$_2$-fragments), including the advantages that are listed on pages 60 and 61 of WO 08/020,079.

In a specific and preferred aspect, the invention provides ISV's or Nanobodies against HER3, and in particular ISV's or Nanobodies against HER3 from a warm-blooded animal, and more in particular ISV's or Nanobodies against HER3 from a mammal, and especially ISV's or Nanobodies against human HER3; as well as proteins and/or polypeptides comprising at least one such ISV or Nanobody.

In particular, the invention provides ISV's or Nanobodies against HER3, and proteins and/or polypeptides comprising the same, that have improved therapeutic and/or pharmacological properties and/or other advantageous properties (such as, for example, improved ease of preparation and/or reduced costs of goods), compared to conventional antibodies against HER3 or fragments thereof, compared to constructs that could be based on such conventional antibodies or antibody fragments (such as Fab' fragments, F(ab')$_2$ fragments, ScFv constructs, "diabodies" and other multispecific constructs (see for example the review by Holliger and Hudson, Nat. Biotechnol. 2005 September; 23(9):1126-36)), and also compared to the so-called "dAb's" or similar (single) domain antibodies that may be derived from variable domains of conventional antibodies. These improved and advantageous properties will become clear from the further description herein, and for example include, without limitation, one or more of:
  increased affinity and/or avidity for HER3, either in a monovalent format, in a multivalent format (for example in a bivalent format) and/or in a multispecific format (for example one of the multispecific formats described herein below);
  better suitability for formatting in a multivalent format (for example in a bivalent format);
  better suitability for formatting in a multispecific format (for example one of the multispecific formats described herein below);
  improved suitability or susceptibility for "humanizing" substitutions (as defined herein);
  less immunogenicity, either in a monovalent format, in a multivalent format (for example in a bivalent format) and/or in a multispecific format (for example one of the multispecific formats described herein below);
  increased stability, either in a monovalent format, in a multivalent format (for example in a bivalent format) and/or in a multispecific format (for example one of the multispecific formats described herein below);
  increased specificity towards HER3, either in a monovalent format, in a multivalent format (for example in a bivalent format) and/or in a multispecific format (for example one of the multispecific formats described herein below);
  decreased or where desired increased cross-reactivity with HER3 from different species;
and/or
  one or more other improved properties desirable for pharmaceutical use (including prophylactic use and/or therapeutic use) and/or for diagnostic use (including but not limited to use for imaging purposes), either in a monovalent format, in a multivalent format (for example in a bivalent format) and/or in a multispecific format (for example one of the multispecific formats described herein below).

As generally described herein for the amino acid sequences of the invention, the ISV's or Nanobodies of the invention are preferably in essentially isolated form (as defined herein), or form part of a protein or polypeptide of the invention (as defined herein), which may comprise or essentially consist of one or more ISV's or Nanobodies of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than HER3), so as to provide a monovalent, multivalent or multispecific polypeptide of the invention, respectively, all as described herein. In particular, such a protein or polypeptide may comprise or essentially consist of one or more ISV's or Nanobodies of the invention and optionally one or more (other) ISV's or Nanobodies (i.e. directed against other targets than HER3), all optionally linked via one or more suitable linkers, so as to provide a monovalent, multivalent or multispecific ISV or Nanobody construct, respectively, as further described herein. Such proteins or polypeptides may also be in essentially isolated form (as defined herein).

In an ISV or Nanobody of the invention, the binding site for binding against HER3 is preferably formed by the CDR sequences. Optionally, an ISV or Nanobody of the invention may also, and in addition to the at least one binding site for binding against HER3, contain one or more further binding sites for binding against other antigens, proteins or targets. For methods and positions for introducing such second binding sites, reference is for example made to Keck and Huston, Biophysical Journal, 71, October 1996, 2002-2011; EP 0 640 130; and WO 06/07260.

As generally described herein for the amino acid sequences of the invention, when an ISV or Nanobody of the invention (or a polypeptide of the invention comprising the same) is intended for administration to a subject (for example for therapeutic and/or diagnostic purposes as described herein), it is preferably directed against human HER3; whereas for veterinary purposes, it is preferably directed against HER3 from the species to be treated. Also, as with the amino acid sequences of the invention, an ISV or Nanobody of the invention may or may not be cross-reactive (i.e. directed against HER3 from two or more species of mammal, such as against human HER3 and HER3 from at least one of the species of mammal mentioned herein).

Also, again as generally described herein for the amino acid sequences of the invention, the ISV's or Nanobodies of the invention may generally be directed against any antigenic determinant, epitope, part, domain, subunit or confirmation (where applicable) of HER3. However, it is generally assumed and preferred that the ISV's or Nanobodies of the invention (and polypeptides comprising the same) are directed against the Heregulin (or "HRG") binding site and the heterodimerization interaction site.

As already described herein, the amino acid sequence and structure of an ISV or Nanobody can be considered—without however being limited thereto—to be comprised of four framework regions or "FR's" (or sometimes also referred to as "FW's"), which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. Some preferred framework sequences and CDR's (and combinations thereof) that are present in the ISV's or Nanobodies of the invention are as described herein. Other suitable CDR sequences can be obtained by the methods described herein.

According to a non-limiting but preferred aspect of the invention, (the CDR sequences present in) the ISV's or Nanobodies of the invention are such that:
  the ISV's or Nanobodies can bind to HER3 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that:
  the ISV's or Nanobodies can bind to HER3 with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;
and/or such that they:
  the ISV's or Nanobodies can bind to HER3 with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, (the CDR sequences present in) the ISV's or Nanobodies of the invention are such that: a monovalent ISV or Nanobody of the invention (or a polypeptide that contains only one ISV or Nanobody of the invention) is preferably such that it will bind to HER3 with an affinity less than 500 nM, preferably less than 100 nM, more preferably less than 10 nM, such as less than 5 nM.

The affinity of the ISV or Nanobody of the invention against HER3 can be determined in a manner known per se, for example using the general techniques for measuring $K_D$, $K_A$, $k_{off}$ or $k_{on}$ mentioned herein, as well as some of the specific assays described herein.

Some preferred IC50 values for binding of the ISV's or Nanobodies of the invention (and of polypeptides comprising the same) to HER3 will become clear from the further description and examples herein.

In a preferred but non-limiting aspect, the invention relates to an ISV or Nanobody (as defined herein) against HER3, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 57 to 71;
b) amino acid sequences that have at least 80% amino acid identity with at least one of the amino acid sequences of SEQ ID NO's: 57 to 71;
c) amino acid sequences that have 3, 2, or 1 amino acid difference with at least one of the amino acid sequences of SEQ ID NO's: 57 to 71;
and/or
CDR2 is chosen from the group consisting of:
d) the amino acid sequences of SEQ ID NO's: 87 to 101;
e) amino acid sequences that have at least 80% amino acid identity with at least one of the amino acid sequences of SEQ ID NO's: 87 to 101;
f) amino acid sequences that have 3, 2, or 1 amino acid difference with at least one of the amino acid sequences of SEQ ID NO's: 87 to 101;
and/or
CDR3 is chosen from the group consisting of:
g) the amino acid sequences of SEQ ID NO's: 117 to 131;
h) amino acid sequences that have at least 80% amino acid identity with at least one of the amino acid sequences of SEQ ID NO's: 117 to 131;
i) amino acid sequences that have 3, 2, or 1 amino acid difference with at least one of the amino acid sequences of SEQ ID NO's: 117 to 131;
or any suitable fragment of such an amino acid sequence.

In particular, according to this preferred but non-limiting aspect, the invention relates to an ISV or Nanobody (as defined herein) against HER3, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 57 to 71;
b) amino acid sequences that have at least 80% amino acid identity with at least one of the amino acid sequences of SEQ ID NO's: 57 to 71;
c) amino acid sequences that have 3, 2, or 1 amino acid difference with at least one of the amino acid sequences of SEQ ID NO's: 57 to 71;
and
CDR2 is chosen from the group consisting of:
d) the amino acid sequences of SEQ ID NO's: 87 to 101;
e) amino acid sequences that have at least 80% amino acid identity with at least one of the amino acid sequences of SEQ ID NO's: 87 to 101;
f) amino acid sequences that have 3, 2, or 1 amino acid difference with at least one of the amino acid sequences of SEQ ID NO's: 87 to 101;
and
CDR3 is chosen from the group consisting of:
g) the amino acid sequences of SEQ ID NO's: 117 to 131;
h) amino acid sequences that have at least 80% amino acid identity with at least one of the amino acid sequences of SEQ ID NO's: 117 to 131;
i) amino acid sequences that have 3, 2, or 1 amino acid difference with at least one of the amino acid sequences of SEQ ID NO's: 117 to 131;
or any suitable fragment of such an amino acid sequences.

As generally mentioned herein for the amino acid sequences of the invention, when an ISV or Nanobody of the invention contains one or more CDR1 sequences according to b) and/or c):
i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when an ISV or Nanobody of the invention contains one or more CDR2 sequences according to e) and/or f):
i) any amino acid substitution in such a CDR according to e) and/or f) is preferably, and compared to the corresponding CDR according to d), a conservative amino acid substitution (as defined herein);
and/or
ii) the CDR according to e) and/or f), preferably only contains amino acid substitutions, and no amino acid deletions or insertions, compared to the corresponding CDR according to d);
and/or
iii) the CDR according to e) and/or f) may be a CDR that is derived from a CDR according to d) by means of affinity maturation using one or more techniques of affinity maturation known per se.

Also, similarly, when an ISV or Nanobody of the invention contains one or more CDR3 sequences according to h) and/or i):
i) any amino acid substitution in such a CDR according to h) and/or i) is preferably, and compared to the corresponding CDR according to g), a conservative amino acid substitution (as defined herein);
and/or
ii) the CDR according to h) and/or i) preferably only contains amino acid substitutions, and no amino acid deletions or insertions, compared to the corresponding CDR according to g);
and/or
iii) the CDR according to h) and/or i) may be a CDR that is derived from a CDR according to g) by means of affinity maturation using one or more techniques of affinity maturation known per se.

It should be understood that the last three paragraphs generally apply to any ISV or Nanobody of the invention that comprises one or more CDR1 sequences, CDR2 sequences and/or CDR3 sequences according to b), c), e), f), h) or i), respectively.

Of the ISV's or Nanobodies of the invention, ISV's or Nanobodies comprising one or more of the CDR's explicitly listed above are particularly preferred; ISV's or Nanobodies comprising two or more of the CDR's explicitly listed above are more particularly preferred; and ISV's or Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table B-1 below, which lists the CDR sequences and framework sequences that are present in a number of preferred (but non-limiting) ISV's or Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table B-1) will usually be preferred (although the invention in its broadest sense is not limited thereto, and also comprises other suitable combinations of the CDR sequences mentioned in Table B-1). Also, a combination of CDR sequences and framework sequences that occur in the same clone (i.e. CDR sequences and framework sequences that are mentioned on the same line in Table B-1) will usually be preferred (although the invention in its broadest sense is not limited thereto, and also comprises other suitable combinations of the CDR sequences and framework sequences mentioned in Table B-1, as well as combinations of such CDR sequences and other suitable framework sequences, e.g. as further described herein).

Also, in the ISV's or Nanobodies of the invention that comprise the combinations of CDR's mentioned in Table B-1, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:
i) any amino acid substitution in such a CDR is preferably, and compared to the corresponding CDR sequence mentioned in Table B-1, a conservative amino acid substitution (as defined herein);
and/or
ii) any such CDR sequence preferably only contains amino acid substitutions, and no amino acid deletions or insertions, compared to the corresponding CDR sequence mentioned in Table B-1;
and/or
iii) any such CDR sequence is a CDR that is derived by means of a technique for affinity maturation known per se, and in particular starting from the corresponding CDR sequence mentioned in Table B-1.

However, as will be clear to the skilled person, the (combinations of) CDR sequences, as well as (the combinations of) CDR sequences and framework sequences mentioned in Table B-1 will generally be preferred.

TABLE B-1

Preferred combinations of CDR sequences, preferred combinations of framework sequences, and preferred combinations of framework and CDR sequences. ("ID" refers to the SEQ ID NO as used herein)

| Clone | ID | FR1 | ID | CDR1 | ID | FR2 | ID | CDR2 | ID | FR3 | ID | CDR3 | ID | FR4 |
|---|---|---|---|---|---|---|---|---|---|---|---|---|---|---|
| 18F05 | 42 | EVQLVESGGG LVQPGGSLRL SCVASGFTFS | 57 | SYWMY | 72 | WVRQAPG KGVEWVS | 87 | AISPGGVE RYTDSVKG | 102 | RFTISRDNAKNT LYLQMNSLKSE DTAMYYCAR | 117 | LTSFATP | 132 | ESQGTQV TVSS |
| 17B05 | 43 | EVQLVESGGG LVQPGGSLRL SCAASGSIGG | 58 | LNAMA | 73 | WYRQAPG KERELVA | 88 | GIFGVGST RYADSVKG | 103 | RFTISRDIAKNTV FLQMNSLNSEDT AVYYCRM | 118 | SSVTRGSSDY | 133 | WGQGTQ VTVSS |

TABLE B-1-continued

Preferred combinations of CDR sequences, preferred combinations of framework sequences, and preferred combinations of framework and CDR sequences.
("ID" refers to the SEQ ID NO as used herein)

| Clone | ID | FR1 | ID | CDR1 | ID | FR2 | ID | CDR2 | ID | FR3 | ID | CDR3 | ID | FR4 |
|---|---|---|---|---|---|---|---|---|---|---|---|---|---|---|
| 18B05 | 44 | EVQLVESGGGLVQAGGSLRLSCAASGLTFG | 59 | SAPMG | 74 | WYRQAPGKERELVA | 89 | YISGDERIWYGDSVKG | 104 | RFTISRDTTKNTLYLQMNSLKPEDTAVYYCVS | 119 | DVKVRH | 134 | WGQGTQVTVSS |
| 04C07 | 45 | EVQLVESGGGLVQAGGSLRLSCAASGFTFS | 60 | SYPMS | 75 | WVRQAPGKGPAWVS | 90 | TVSPGGITTSYADSVKG | 105 | RFTISRDNAKNTLYLQMNSLKPEDTAVYYCLR | 120 | DLNN | 135 | RGQGTQVTVSS |
| 18G11 | 46 | EVQLVESGGGLVQPGGSLRLSCAASGTLFK | 61 | INAMG | 76 | WYRQAPGKRRELVA | 91 | LITSSDTTDYAESVEG | 106 | RFTISRDNTWNAVYLQMNSLKPEDTAVYYCHS | 121 | DHYSMGVPEKRVIM | 136 | YGQGTQVTVSS |
| 18E08 | 47 | EVQLVESGGGLVQPGGSLRLSCAASGTLFK | 62 | INAMG | 77 | WYRQAPGKQRELVA | 92 | LITSSDTTDYAESVEG | 107 | RFTISRDNTWNAVYLQMNSLKPEDTAVYYCHS | 122 | DHYSMGVPEKRVIM | 137 | YGQGTQVTVSS |
| 34C07 | 48 | EVQLVESGGGLVQPGGSLGLSCVASGSIFR | 63 | INAMA | 78 | WYRQAPGKQRELVA | 93 | EITAGGSTNYADSVKG | 108 | RFTISVDNAWNTLYLQMNSLKVEDTAVYYCNL | 123 | DHYTTWDRRSAY | 138 | WGQGTQVTVSS |
| 05A09 | 49 | EVQLVESGGGLVQAGGSLRLSCAASGFTFD | 64 | DYAIG | 79 | WFRQAPGKEREGVS | 94 | CISSSDGSTVYADSVKG | 109 | RFTISSDNAKNTVYLQMNSLKPEDTAVYYCAA | 124 | ERRGYSDLCRFYYGMDY | 139 | WGKGTQVTVSS |
| 17C08 | 50 | EVQLVESGGGLMQAGDSLRLSCAASGRAFS | 65 | SYALG | 80 | WFRRAPGKERECVA | 95 | ATDRLGDNTYFPDSVKG | 110 | RFTISRDNAKNTLYLQMNNLKPEDTAVYYCAA | 125 | GAVRYGVSTSPMNYNY | 140 | WGQGTQVTVSS |
| 21B02 | 51 | EVQLVESGGGLVQPGGSLRLSCAASGFTFD | 66 | YYTIG | 81 | WFRQAPGKEREGVS | 96 | CISSRDGDSYYADSVKG | 111 | RFTISRDNAKNTAYLQMNSLKPEDTAVYYCAA | 126 | SASDYGLGLELFHDEYNY | 141 | WGQGTQVTVSS |
| 21F06 | 52 | EVQLVESGGGLVQAGGSLRLSCAASGRTYY | 67 | LNAMG | 82 | WFRQGPGKDREFVA | 97 | AIDWSDGNKDYADSVKG | 112 | RFTISRDNAKNTVYLQMNSLKPEDTAVYYCAA | 127 | DTPPWGPMIYIESYDS | 142 | WGQGTQVTVSS |
| 23F05 | 53 | EVQLVESGGGLVQAGGSLRLSCAASGFTFD | 68 | GYAIG | 83 | WFRQAPGKEREGVS | 98 | CISGGDGRSYYADSVKG | 113 | RFTVSSDNAKNTLYLEMNSLKPEDTAVYYCAV | 128 | IWGPYCSDSYEYLYEYDY | 143 | WGQGTQVTVSS |
| 34A04 | 54 | EVQLVESGGGLVQAGGSLRLSCAASGFTFD | 69 | DYTIG | 84 | WFRQAPGKEREEIS | 99 | CISNNDGSTYYTNSVKG | 114 | RFTISSDNAKNTVYLQMNSLKPEDTAVYYCAA | 129 | SPHGCWYDLIPLQADFGS | 144 | WGQGTQVTVSS |
| 17E08 | 55 | EVQLVESGGGLVQPGGSLRLSCSASGSIFG | 70 | LNAMG | 85 | WYRQTPGKERELVA | 100 | GITSITRVGSTRYADSAKG | 115 | RFTISGDYAKNTVYLQMNSLKPEDTGVYYCRM | 130 | SIVKSGGADY | 145 | WGQGTQVTVSS |
| 4F10 | 56 | EVQLVESGGGLVQPGGSLKLSCVASGSMFR | 71 | FYHMA | 86 | WYRQAPGEQRELVA | 101 | RIYTGGDTIYGDSVLG | 116 | RFTISRDNSKNTVYLQMNTLKPEDTGVYYCNA | 131 | FREYHI | 146 | WGQGTQVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table B-1; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table B-1; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table B-1.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to HER3 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table B-1 or from the group of CDR3 sequences that have at least 80%, preferably at least 90%, more preferably at least 95%, even more preferably at least 99% sequence identity with at least one of the CDR3 sequences listed in Table B-1; and/or from the group consisting of the CDR3 sequences that have 3, 2 or only 1 amino acid difference(s) with at least one of the CDR3 sequences listed in Table B-1.

Preferably, in the Nanobodies of the invention, at least two of the CDR1, CDR2 and CDR3 sequences present are suitably chosen from the group consisting of the CDR1, CDR2 and CDR3 sequences, respectively, listed in Table B-1 or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table B-1; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table B-1.

In particular, in the Nanobodies of the invention, at least the CDR3 sequence present is suitably chosen from the group consisting of the CDR3 sequences listed in Table B-1 or from the group of CDR3 sequences that have at least 80%, preferably at least 90%, more preferably at least 95%, even more preferably at least 99% sequence identity with at least one of the CDR3 sequences listed in Table B-1, respectively; and at least one of the CDR1 and CDR2 sequences present is suitably chosen from the group consisting of the CDR1 and CDR2 sequences, respectively, listed in Table B-1 or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table B-1; and/or from the group consisting of the CDR1 and CDR2 sequences, respectively, that have 3, 2 or only 1 amino acid difference(s) with at least one of the CDR1 and CDR2 sequences, respectively, listed in Table B-1.

Most preferably, in the Nanobodies of the invention, all three CDR1, CDR2 and CDR3 sequences present are suitably chosen from the group consisting of the CDR1, CDR2 and CDR3 sequences, respectively, listed in Table B-1 or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table B-1; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table B-1.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table B-1. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table B-1; and/or from the group consisting of the CDR sequences that have 3, 2 or only 1 amino acid difference(s) with at least one of the corresponding sequences, respectively, listed in Table B-1.

In particular, in the Nanobodies of the invention, at least the CDR3 sequence present is suitably chosen from the group consisting of the CDR3 listed in Table B-1. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table B-1; and/or from the group consisting of the CDR1 and CDR2 sequences, respectively, that have 3, 2 or only 1 amino acid difference(s) with at least one of the CDR1 and CDR2 sequences, respectively, listed in Table B-1.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table B-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table B-1; and/or from the group consisting of CDR sequences that have 3, 2 or only 1 amino acid difference(s) with at least one of the corresponding sequences listed in Table B-1.

In particular, in the Nanobodies of the invention, at least the CDR3 sequence is suitably chosen from the group consisting of the CDR3 sequences listed in Table B-1, and either the CDR1 sequence or the CDR2 sequence is suitably chosen from the group consisting of the CDR1 and CDR2 sequences, respectively, listed in Table B-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table B-1; and/or from the group consisting of CDR sequences that have 3, 2 or only 1 amino acid difference(s) with the corresponding CDR sequences listed in Table B-1.

Even more preferably, in the Nanobodies of the invention, all three CDR1, CDR2 and CDR3 sequences present are suitably chosen from the group consisting of the CDR1, CDR2 and CDR3 sequences, respectively, listed in Table B-1.

Also, generally, the combinations of CDR's listed in Table B-1 (i.e. those mentioned on the same line in Table B-1) are preferred. Thus, it is generally preferred that, when a CDR in a Nanobody of the invention is a CDR sequence mentioned in Table B-1 or is suitably chosen from the group of CDR sequences that have at least 80%, preferably at least 90%, more preferably at least 95%, even more preferably at least 99% sequence identity with a CDR sequence listed in Table B-1; and/or from the group consisting of CDR sequences that have 3, 2 or only 1 amino acid difference(s) with a CDR sequence listed in Table B-1, that at least one and preferably both of the other CDR's are suitably chosen from the CDR sequences that belong to the same combination in Table B-1 (i.e. mentioned on the same line in Table B-1) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table B-1.

Thus, by means of non-limiting examples, a Nanobody of the invention can for example comprise a CDR1 sequence that has more than 80% sequence identity with one of the CDR1 sequences mentioned in Table B-1, a CDR2 sequence that has 3, 2 or 1 amino acid difference with one of the CDR2 sequences mentioned in Table B-1 (but belonging to a different combination), and a CDR3 sequence.

Some preferred Nanobodies of the invention may for example comprise: (1) a CDR1 sequence that has more than 80% sequence identity with one of the CDR1 sequences mentioned in Table B-1; a CDR2 sequence that has 3, 2 or 1 amino acid difference with one of the CDR2 sequences mentioned in Table B-1 (but belonging to a different combination); and a CDR3 sequence that has more than 80% sequence identity with one of the CDR3 sequences mentioned in Table B-1 (but belonging to a different combination); or (2) a CDR1 sequence that has more than 80% sequence identity with one of the CDR1 sequences mentioned in Table B-1; a CDR2 sequence, and one of the CDR3 sequences listed in Table B-1; or (3) a CDR1 sequence; a CDR2 sequence that has more than 80% sequence identity with one of the CDR2 sequence listed in Table B-1; and a CDR3 sequence that has 3, 2 or 1 amino acid differences with the CDR3 sequence mentioned in Table B-1 that belongs to the same combination as the CDR2 sequence.

Some particularly preferred Nanobodies of the invention may for example comprise: (1) a CDR1 sequence that has more than 80% sequence identity with one of the CDR1 sequences mentioned in Table B-1; a CDR2 sequence that has 3, 2 or 1 amino acid difference with the CDR2 sequence mentioned in Table B-1 that belongs to the same combination; and a CDR3 sequence that has more than 80% sequence identity with the CDR3 sequence mentioned in Table B-1 that belongs to the same combination; (2) a CDR1 sequence; a CDR 2 listed in Table B-1 and a CDR3 sequence listed in Table B-1 (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table B-1; the CDR2 sequence listed in Table B-1 that belongs to the same combination; and a CDR3 sequence mentioned in Table B-1 that belongs to a different combination; or (2) a CDR1 sequence mentioned in Table B-1; a CDR2 sequence that has 3, 2 or 1 amino acid differences with the CDR2 sequence mentioned in Table B-1 that belongs to the same combination; and a CDR3 sequence that has more than 80% sequence identity with the CDR3 sequence listed in Table B-1 that belongs to the same or a different combination.

Particularly preferred Nanobodies of the invention may for example comprise a CDR1 sequence mentioned in Table B-1, a CDR2 sequence that has more than 80% sequence identity with the CDR2 sequence mentioned in Table B-1 that belongs to the same combination; and the CDR3 sequence mentioned in Table B-1 that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table B-1.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 12 to 26 (see Table A-1).

Generally, Nanobodies with the above CDR sequences may be as further described herein, and preferably have framework sequences that are also as further described herein.

For example, as already mentioned, the framework sequences present in the nanobodies may be as generally described on pages 258 to 297 of WO 09/068,627 (incorporated herein by reference). For example, they may contain one or more of the combinations of Hallmark residues set out in Table A-5 of WO 09/068,627; and FR1, FR2, FR3 and FR4 may contain the amino acid residues set out in Table A-6, Table A-7, Table A-8 and Table A-9 of WO 09/068,627, respectively. Also, when the ISV's of the invention are Nanobodies, they may belong to the KERE-group (see pages 281 to 284 of WO 09/068,627, with some representative FR1, FR2, FR3 and FR4 sequences for this group given in Tables A-11/A-15, A-12, A-13 and A-14 of WO 09/068,627); to the GLEW-group (see pages 285 to 287 of WO 09/068,627, with some representative FR1, FR2, FR3 and FR4 sequences for this group given in Tables A-16/A-20, A-17, A-18 and A-19 of WO 09/068,627); or to the P, R, S 103 group (see pages 287 to 291 of WO 09/068,627, with some representative FR1, FR2, FR3 and FR4 sequences for this group given in Tables A-21/A-25, A-22, A-23 and A-24 of WO 09/068,627), which are all as described in WO 09/068,627, with some representative sequences for each of these groups given in Table A-10 of WO 09/068,627. As also described in WO 09/068,627, these framework sequences may contain one or more suitable humanizing substitutions or (other) substitutions for optimizing the sequence (see also the further disclosure herein).

Again, some particularly preferred but non-limiting FR1, FR2, FR3 and FR4 sequences (and combinations thereof) are those described in Table B-1, or suitable variants of such FR1, FR2, FR3 and FR4 sequences, respectively (for example, with less than 5, such as 1, 2, 3, 4 or 5 suitable amino acid differences in such an FR1, FR2, FR3 or FR4 compared to a framework sequence mentioned in Table B-1, in which the amino acid differences may be as described in WO 09/068,627) that still essentially retain the desired properties of Nanobodies.

Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

Also, in addition to humanizing substitutions as described herein, the ISV's and in particular nanobodies of the invention may contain one or more other/further substitutions. Again, some preferred, but non-limiting examples of such other/further substitutions will become clear from the further description herein, and for example may include (and preferably essentially consist of) one or more of the following substitutions:

(a) one or more conservative amino acid substitutions; and/or
(b) one or more substitutions in which a "camelid" amino acid residue at a certain position is replaced by a different "camelid" amino acid residue that occurs at said position, for which reference is for example made to Tables A-6 to A-9 from PCT/EP2008/066365 (published on Jun. 4, 2009 as WO 09/068,627), which mention the various Camelid residues that occur as each amino acid position in wild-type VHH's. Such substitutions may even comprise suitable substitutions of an amino acid residue that occurs at a Hallmark position with another amino acid residue that occurring at a Hallmark position in a wild-type VHH (for which reference is for example made to Tables A-6 to A-9 from PCT/EP2008/066365); and/or
(c) one or more substitutions that improve the (other) properties of the protein, such as substitutions that improve the long-term stability and/or properties under storage of the protein. These may for example and without limitation be substitutions that prevent or reduce oxidation events (for example, of methionine residues); that prevent or reduce pyroglutamate formation; and/or that prevent or reduce isomerisation or deamidation of aspartic acids or asparagines (for example, of DG, DS, NG or NS motifs). For such substitutions, reference is for example made to the International application WO 09/095,235, which is generally directed to methods for stabilizing single immunoglobulin variable domains by means of such substitutions, and also gives some specific example of suitable substitutions (see for example pages 4 and 5 and pages 10 to 15). One example of such substitution may be to replace an NS motif at positions 82a and 82b with an NN motif.

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 12 to 26 (see Table A-1). This degree of amino acid identity can for example be determined by determining the degree of amino acid identity (in a manner described herein) between said Nanobody and one or more of the sequences of SEQ ID NO's: 12 to 26 (see Table A-1), in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 12 to 26 (see Table A-1) or from the group consisting of from amino acid sequences that have more than 80%, preferably more than 90%, more preferably more than 95%, such as 99% or more sequence identity (as defined herein) with at least one of the amino acid sequences of SEQ ID NO's: 12 to 26 (see Table A-1).

Another preferred, but non-limiting aspect of the invention relates to humanized variants of the Nanobodies of SEQ ID NO's: 12 to 26 (see Table A-1), that comprise, compared to the corresponding native $V_{HH}$ sequence, at least one humanizing substitution (as defined herein), and in particular at least one humanizing substitution in at least one of its framework sequences (as defined herein).

The polypeptides of the invention comprise or essentially consist of at least one Nanobody of the invention. Some preferred, but non-limiting examples of polypeptides of the invention are given in SEQ ID NO's: 147 to 327, more preferably HER3MS00135 (SEQ ID NO:282), HER3MS00212 (SEQ ID NO:319) or HER3MS00215 (SEQ ID NO:322) (see Table A-2). It should be noted that some of the sequences listed in the Table below (SEQ ID NO's: 224-231, 241-281, 318 and SEQ ID NO's: 323-327) contain a C-terminal tag (e.g. a His-tag of 6H). In practice, these polypeptides may also be used (and for example for therapeutic purposes preferably are used) without the (C-terminal) tag, and the (C-terminal) tag should also be disregarded for the purposes of determining the degree of sequence identity to each of these sequences.

TABLE A-2

Preferred polypeptide or compound sequences (also referred herein as a sequence with a particular name or SEQ ID NO: X, wherein X is a number referring to the relevant amino acid sequence):

| Name | SEQ ID NO: X, wherein X = | Amino acid sequence |
|---|---|---|
| 17C8-35GS-17C8-9GS-ALB8 | 147 | EVQLVESGGGLMQAGDSLRLSCAASGRAFSSYALGWFRRAPGKE REFVAATDRLGDNTYFPDSVKGRFTISRDNAKNTLYLQMNNLKPE DTAVYYCAAGAVRYGVSTSPMNYNYWGQGTLVTVSSGGGGSGG GGSGGGGSGGGGSGGGGSGGGGSGGGGSEVQLVESGGGLMQAG DSLRLSCAASGRAFSSYALGWFRRAPGKEREFVAATDRLGDNTYF PDSVKGRFTISRDNAKNTLYLQMNNLKPEDTAVYYCAAGAVRYG VSTSPMNYNYWGQGTLVTVSSGGGGSGGGGSEVQLVESGGGLVQP GNSLRLSCAASGFTFSSFGMSWVRQAPGKGLEWVSSISGSGSDTL |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
| --- | --- | --- |
| | | YADSVKGRFTISRDNAKTTLYLQMNSLRPEDTAVYYCTIGGSLSR SSQGTLVTVSS |
| 17C8- 35GS- 18F5-9GS- ALB8 | 148 | EVQLVESGGGLMQAGDSLRLSCAASGRAFSSYALGWFRRAPGKE REFVAATDRLGDNTYFPDSVKGRFTISRDNAKNTLYLQMNNLKPE DTAVYYCAAGAVRYGVSTSPMNYNYWGQGTLVTVSSGGGGSGG GGSGGGGSGGGGSGGGGSGGGGSGGGGSEVQLVESGGGLVQPG GSLRLSCVASGFTFSSYWMYWVRQAPGKGVEWVSAISPGGVERY TDSVKGRFTISRDNAKNTLYLQMNSLKSEDTAMYYCARLTSFATP ESQGTLVTVSSGGGGSGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| 17C8- 35GS- 21F06- 9GS-ALB8 | 149 | EVQLVESGGGLMQAGDSLRLSCAASGRAFSSYALGWFRRAPGKE REFVAATDRLGDNTYFPDSVKGRFTISRDNAKNTLYLQMNNLKPE DTAVYYCAAGAVRYGVSTSPMNYNYWGQGTLVTVSSGGGGSGG GGSGGGGSGGGGSGGGGSGGGGSEVQLVESGGGLVQAG GSLRLSCAASGRTYYLNAMGWFRQGPGKDREFVAAIDWSDGNK DYADSVKGRFTISRDNAKNTVYLQMNSLKPEDTAVYYCAADTPP WGPMIYIESYDSWGQGTLVTVSSGGGGSGGGSEVQLVESGGGLV QPGNSLRLSCAASGFTFSSFGMSWVRQAPGKGLEWVSSISGSGSD TLYADSVKGRFTISRDNAKTTLYLQMNSLRPEDTAVYYCTIGGSL SRSSQGTLVTVSS |
| 17C8- 35GS-4C7- 9GS-ALB8 | 150 | EVQLVESGGGLMQAGDSLRLSCAASGRAFSSYALGWFRRAPGKE REFVAATDRLGDNTYFPDSVKGRFTISRDNAKNTLYLQMNNLKPE DTAVYYCAAGAVRYGVSTSPMNYNYWGQGTLVTVSSGGGGSGG GGSGGGGSGGGGSGGGGSGGGGSEVQLVESGGGLVQAG GSLRLSCAASGFTFSSYPMSWVRQAPGKGPAWVSTVSPGGITTSY ADSVKGRFTISRDNAKNTLYLQMNSLKPEDTAVYYCLRDLNNRG QGTLVTVSSGGGGSGGGSEVQLVESGGGLVQPGNSLRLSCAASGF TFSSFGMSWVRQAPGKGLEWVSSISGSGSDTLYADSVKGRFTISR DNAKTTLYLQMNSLRPEDTAVYYCTIGGSLSRSSQGTLVTVSS |
| 18F5- 35GS- 17C8-9GS- ALB8 | 151 | EVQLVESGGGLVQPGGSLRLSCVASGFTFSSYWMYWVRQAPGKG VEWVSAISPGGVERYTDSVKGRFTISRDNAKNTLYLQMNSLKSED TAMYYCARLTSFATPESQGTLVTVSSGGGGSGGGGSGGGGSGGG GSGGGGSGGGGSGGGGSEVQLVESGGGLMQAGDSLRLSCAASGR AFSSYALGWFRRAPGKEREFVAATDRLGDNTYFPDSVKGRFTISR DNAKNTLYLQMNNLKPEDTAVYYCAAGAVRYGVSTSPMNYNY WGQGTLVTVSSGGGGSGGGSEVQLVESGGGLVQPGNSLRLSCAA SGFTFSSFGMSWVRQAPGKGLEWVSSISGSGSDTLYADSVKGRFTI SRDNAKTTLYLQMNSLRPEDTAVYYCTIGGSLSRSSQGTLVTVSS |
| 18F5- 35GS- 18F5-9GS- ALB8 | 152 | EVQLVESGGGLVQPGGSLRLSCVASGFTFSSYWMYWVRQAPGKG VEWVSAISPGGVERYTDSVKGRFTISRDNAKNTLYLQMNSLKSED TAMYYCARLTSFATPESQGTLVTVSSGGGGSGGGGSGGGGSGGG GSGGGGSGGGGSGGGGSEVQLVESGGGLVQPGGSLRLSCVASGF TFSSYWMYWVRQAPGKGVEWVSAISPGGVERYTDSVKGRFTISR DNAKNTLYLQMNSLKSEDTAMYYCARLTSFATPESQGTLVTVSS GGGGSGGGSEVQLVESGGGLVQPGNSLRLSCAASGFTFSSFGMS WVRQAPGKGLEWVSSISGSGSDTLYADSVKGRFTISRDNAKTTLY LQMNSLRPEDTAVYYCTIGGSLSRSSQGTLVTVSS |
| 18F5- 35GS- 21F6-9GS- ALB8 | 153 | EVQLVESGGGLVQPGGSLRLSCVASGFTFSSYWMYWVRQAPGKG VEWVSAISPGGVERYTDSVKGRFTISRDNAKNTLYLQMNSLKSED TAMYYCARLTSFATPESQGTLVTVSSGGGGSGGGGSGGGGSGGG GSGGGGSGGGGSGGGGSEVQLVESGGGLVQAGGSLRLSCAASGR TYYLNAMGWFRQGPGKDREFVAAIDWSDGNKDYADSVKGRFTI SRDNAKNTVYLQMNSLKPEDTAVYYCAADTPPWGPMIYIESYDS WGQGTLVTVSSGGGGSGGGSEVQLVESGGGLVQPGNSLRLSCAA SGFTFSSFGMSWVRQAPGKGLEWVSSISGSGSDTLYADSVKGRFTI SRDNAKTTLYLQMNSLRPEDTAVYYCTIGGSLSRSSQGTLVTVSS |
| 18F5- 35GS- 34C7-9GS- ALB8 | 154 | EVQLVESGGGLVQPGGSLRLSCVASGFTFSSYWMYWVRQAPGKG VEWVSAISPGGVERYTDSVKGRFTISRDNAKNTLYLQMNSLKSED TAMYYCARLTSFATPESQGTLVTVSSGGGGSGGGGSGGGGSGGG GSGGGGSGGGGSGGGGSEVQLVESGGGLVQPGGSLGLSCVASGSI FRINAMAWYRQAPGKQRELVAEITAGGSTNYADSVKGRFTISVD NAWNTLYLQMNSLKVEDTAVYYCNLDHYTTWDRRSAYWGQGT |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | LVTVSSGGGGSGGGSEVQLVESGGGLVQPGNSLRLSCAASGFTFS SFGMSWVRQAPGKGLEWVSSISGSGSDTLYADSVKGRFTISRDNA KTTLYLQMNSLRPEDTAVYYCTIGGSLSRSSQGTLVTVSS |
| 21F6-35GS-17C8-9GS-ALB8 | 155 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLMQA GDSLRLSCAASGRAFSSYALGWFRRAPGKEREFVAATDRLGDNT YFPDSVKGRFTISRDNAKNTLYLQMNNLKPEDTAVYYCAAGAVR YGVSTSPMNYNYWGQGTLVTVSSGGGGSGGGSEVQLVESGGGL VQPGNSLRLSCAASGFTFSSFGMSWVRQAPGKGLEWVSSISGSGS DTLYADSVKGRFTISRDNAKTTLYLQMNSLRPEDTAVYYCTIGGS LSRSSQGTLVTVSS |
| 21F6-35GS-18F5-9GS-ALB8 | 156 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQP GGSLRLSCVASGFTFSSYWMYWVRQAPGKGVEWVSAISPGGVER YTDSVKGRFTISRDNAKNTLYLQMNSLKSEDTAMYYCARLTSFA TPESQGTLVTVSSGGGGSGGGSEVQLVESGGGLVQPGNSLRLSCA ASGFTFSSFGMSWVRQAPGKGLEWVSSISGSGSDTLYADSVKGRF TISRDNAKTTLYLQMNSLRPEDTAVYYCTIGGSLSRSSQGTLVTVSS |
| 21F6-35GS-21F6-9GS-ALB8 | 157 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQA GGSLRLSCAASGRTYYLNAMGWFRQGPGKDREFVAAIDWSDGN KDYADSVKGRFTISRDNAKNTVYLQMNSLKPEDTAVYYCAADTP PWGPMIYIESYDSWGQGTLVTVSSGGGGSGGGSEVQLVESGGGL VQPGNSLRLSCAASGFTFSSFGMSWVRQAPGKGLEWVSSISGSGS DTLYADSVKGRFTISRDNAKTTLYLQMNSLRPEDTAVYYCTIGGS LSRSSQGTLVTVSS |
| 21F6-35GS-34C7-9GS-ALB8 | 158 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQP GGSLGLSCVASGSIFRINAMAWYRQAPGKQRELVAEITAGGSTNY ADSVKGRFTISVDNAWNTLYLQMNSLKVEDTAVYYCNLDHYTT WDRRSAYWGQGTLVTVSSGGGGSGGGSEVQLVESGGGLVQPGN SLRLSCAASGFTFSSFGMSWVRQAPGKGLEWVSSISGSGSDTLYA DSVKGRFTISRDNAKTTLYLQMNSLRPEDTAVYYCTIGGSLSRSSQ GTLVTVSS |
| 21F6-35GS-4C7-9GS-ALB8 | 159 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQA GGSLRLSCAASGFTFSSYPMSWVRQAPGKGPAWVSTVSPGGITTS YADSVKGRFTISRDNAKNTLYLQMNSLKPEDTAVYYCLRDLNNR GQGTLVTVSSGGGGSGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| 34C7-35GS-18F5-9GS-ALB8 | 160 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTLVTVSSGGGGSGGGGSG GGGSGGGGSGGGGSGGGGSEVQLVESGGGLVQPGGSLRL SCVASGFTFSSYWMYWVRQAPGKGVEWVSAISPGGVERYTDSVK GRFTISRDNAKNTLYLQMNSLKSEDTAMYYCARLTSFATPESQGT LVTVSSGGGGSGGGSEVQLVESGGGLVQPGNSLRLSCAASGFTFS SFGMSWVRQAPGKGLEWVSSISGSGSDTLYADSVKGRFTISRDNA KTTLYLQMNSLRPEDTAVYYCTIGGSLSRSSQGTLVTVSS |
| 34C7-35GS-21F6-9GS- | 161 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTLVTVSSGGGGSGGGGSG |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| ALB8 | | GGGSGGGGSGGGGSGGGGSGGGGSEVQLVESGGGLVQAGGSLR LSCAASGRTYYLNAMGWFRQGPGKDREFVAAIDWSDGNKDYAD SVKGRFTISRDNAKNTVYLQMNSLKPEDTAVYYCAADTPPWGPM IYIESYDSWGQGTLVTVSSGGGGSGGGGSEVQLVESGGGLVQPGNS LRLSCAASGFTFSSFGMSWVRQAPGKGLEWVSSISGSGSDTLYAD SVKGRFTISRDNAKTTLYLQMNSLRPEDTAVYYCTIGGSLSRSSQG TLVTVSS |
| 34C7-35GS-34C7-9GS-ALB8 | 162 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTLVTVSSGGGGSGGGGSG GGGSGGGGSGGGGSGGGGSEVQLVESGGGLVQPGGSLGL SCVASGSIFRINAMAWYRQAPGKQRELVAEITAGGSTNYADSVKG RFTISVDNAWNTLYLQMNSLKVEDTAVYYCNLDHYTTWDRRSA YWGQGTLVTVSSGGGGSGGGGSEVQLVESGGGLVQPGNSLRLSCA ASGFTFSSFGMSWVRQAPGKGLEWVSSISGSGSDTLYADSVKGRF TISRDNAKTTLYLQMNSLRPEDTAVYYCTIGGSLSRSSQGTLVTVSS |
| 34C7-35GS-4C7-9GS-ALB8 | 163 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTLVTVSSGGGGSGGGGSG GGGSGGGGSGGGGSGGGGSEVQLVESGGGLVQAGGSLR LSCAASGFTFSSYPMSWVRQAPGKGPAWVSTVSPGGITTSYADSV KGRFTISRDNAKNTLYLQMNSLKPEDTAVYYCLRDLNNRGQGTL VTVSSGGGGSGGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSS |
| 4C7-35GS-17C8-9GS-ALB8 | 164 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLMQAGDSLRLSCAASGRA FSSYALGWFRRAPGKEREFVAATDRLGDNTYFPDSVKGRFTISRD NAKNTLYLQMNNLKPEDTAVYYCAAGAVRYGVSTSPMNYNYW GQGTLVTVSSGGGGSGGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| 4C7-35GS-21F6-9GS-ALB8 | 165 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQAGGSLRLSCAASGRT YYLNAMGWFRQGPGKDREFVAAIDWSDGNKDYADSVKGRFTIS RDNAKNTVYLQMNSLKPEDTAVYYCAADTPPWGPMIYIESYDSW GQGTLVTVSSGGGGSGGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| 4C7-35GS-34C7-9GS-ALB8 | 166 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQPGGSLGLSCVASGSIF RINAMAWYRQAPGKQRELVAEITAGGSTNYADSVKGRFTISVDN AWNTLYLQMNSLKVEDTAVYYCNLDHYTTWDRRSAYWGQGTL VTVSSGGGGSGGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSS |
| 4C7-35GS-4C7-9GS-ALB8 | 167 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQAGGSLRLSCAASGFT FSSYPMSWVRQAPGKGPAWVSTVSPGGITTSYADSVKGRFTISRD NAKNTLYLQMNSLKPEDTAVYYCLRDLNNRGQGTLVTVSSGGG GSGGGGSEVQLVESGGGLVQPGNSLRLSCAASGFTFSSFGMSWVR QAPGKGLEWVSSISGSGSDTLYADSVKGRFTISRDNAKTTLYLQMN SLRPEDTAVYYCTIGGSLSRSSQGTLVTVSS |
| 18F5-35GS- | 168 | EVQLVESGGGLVQPGGSLRLSCVASGFTFSSYWMYWVRQAPGKG VEWVSAISPGGVERYTDSVKGRFTISRDNAKNTLYLQMNSLKSED |

TABLE A-2-continued

Preferred polypeptide or compound sequences (also referred herein as a sequence with a particular name or SEQ ID NO: X, wherein X is a number referring to the relevant amino acid sequence):

| Name | SEQ ID NO: X, wherein X = | Amino acid sequence |
|---|---|---|
| 18G11-9GS-ALB8 | | TAMYYCARLTSFATPESQGTLVTVSSGGGGSGGGGSGGGGSGGG GSGGGGSGGGGSGGGGSEVQLVESGGGLVQPGGSLRLSCAASGT LFKINAMGWYRQAPGKRRELVALITSSDTTDYAESVEGRFTISRD NTWNAVYLQMNSLKPEDTAVYYCHSDHYSMGVPEKRVIMYGQG TLVTVSSGGGGSGGGSEVQLVESGGGLVQPGNSLRLSCAASGFTF SSFGMSWVRQAPGKGLEWVSSISGSGSDTLYADSVKGRFTISRDN AKTTLYLQMNSLRPEDTAVYYCTIGGSLSRSSQGTLVTVSS |
| 21F6-35GS-18G11-9GS-ALB8 | 169 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSGGGGSEVQLVESGGGLVQP GGSLRLSCAASGTLFKINAMGWYRQAPGKRRELVALITSSDTTDY AESVEGRFTISRDNTWNAVYLQMNSLKPEDTAVYYCHSDHYSMG VPEKRVIMYGQGTLVTVSSGGGGSGGGSEVQLVESGGGLVQPGN SLRLSCAASGFTFSSFGMSWVRQAPGKGLEWVSSISGSGSDTLYA DSVKGRFTISRDNAKTTLYLQMNSLRPEDTAVYYCTIGGSLSRSSQ GTLVTVSS |
| 4C7-35GS-18G11-9GS-ALB8 | 170 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQPGGSLRLSCAASGTL FKINAMGWYRQAPGKRRELVALITSSDTTDYAESVEGRFTISRDN TWNAVYLQMNSLKPEDTAVYYCHSDHYSMGVPEKRVIMYGQGT LVTVSSGGGGSGGGSEVQLVESGGGLVQPGNSLRLSCAASGFTFS SFGMSWVRQAPGKGLEWVSSISGSGSDTLYADSVKGRFTISRDNA KTTLYLQMNSLRPEDTAVYYCTIGGSLSRSSQGTLVTVSS |
| 18G11-35GS-18F5-9GS-ALB8 | 171 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSGGGGSEVQLVESGGGLVQPGGSL RLSCVASGFTFSSYWMYWVRQAPGKGVEWVSAISPGGVERYTDS VKGRFTISRDNAKNTLYLQMNSLKSEDTAMYYCARLTSFATPESQ GTLVTVSSGGGGSGGGSEVQLVESGGGLVQPGNSLRLSCAASGFT FSSFGMSWVRQAPGKGLEWVSSISGSGSDTLYADSVKGRFTISRD NAKTTLYLQMNSLRPEDTAVYYCTIGGSLSRSSQGTLVTVSS |
| 18G11-35GS-18G11-9GS-ALB8 | 172 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSGGGGSEVQLVESGGGLVQPGGSL RLSCAASGTLFKINAMGWYRQAPGKRRELVALITSSDTTDYAESV EGRFTISRDNTWNAVYLQMNSLKPEDTAVYYCHSDHYSMGVPEK RVIMYGQGTLVTVSSGGGGSGGGSEVQLVESGGGLVQPGNSLRL SCAASGFTFSSFGMSWVRQAPGKGLEWVSSISGSGSDTLYADSVK GRFTISRDNAKTTLYLQMNSLRPEDTAVYYCTIGGSLSRSSQGTLV TVSS |
| 18G11-35GS-21F6-9GS-ALB8 | 173 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSEVQLVESGGGLVQAGGSL RLSCAASGRTYYLNAMGWFRQGPGKDREFVAAIDWSDGNKDYA DSVKGRFTISRDNAKNTVYLQMNSLKPEDTAVYYCAADTPPWGP MIYIESYDSWGQGTLVTVSSGGGGSGGGSEVQLVESGGGLVQPG NSLRLSCAASGFTFSSFGMSWVRQAPGKGLEWVSSISGSGSDTLY ADSVKGRFTISRDNAKTTLYLQMNSLRPEDTAVYYCTIGGSLSRSS QGTLVTVSS |
| 18G11-35GS-4C7-9GS-ALB8 | 174 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSEVQLVESGGGLVQAGGSL RLSCAASGFTFSSYPMSWVRQAPGKGPAWVSTVSPGGITTSYADS VKGRFTISRDNAKNTLYLQMNSLKPEDTAVYYCLRDLNNRGQGT LVTVSSGGGGSGGGSEVQLVESGGGLVQPGNSLRLSCAASGFTFS SFGMSWVRQAPGKGLEWVSSISGSGSDTLYADSVKGRFTISRDNA KTTLYLQMNSLRPEDTAVYYCTIGGSLSRSSQGTLVTVSS |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| 18F05-<br>35GS-<br>4C07-9GS-<br>ALB8 | 175 | EVQLVESGGGLVQPGGSLRLSCVASGFTFSSYWMYWVRQAPGKG<br>VEWVSAISPGGVERYTDSVKGRFTISRDNAKNTLYLQMNSLKSED<br>TAMYYCARLTSFATPESQGTLVTVSSGGGGSGGGGSGGGGSGGG<br>GSGGGGSGGGGSGGGGSEVQLVESGGGLVQAGGSLRLSCAASGF<br>TFSSYPMSWVRQAPGKGPAWVSTVSPGGITTSYADSVKGRFTISR<br>DNAKNTLYLQMNSLKPEDTAVYYCLRDLNNRGQGTQVTVSSGG<br>GGSGGGSEVQLVESGGGLVQPGNSLRLSCAASGFTFSSFGMSWVR<br>QAPGKGLEWVSSISGSGSDTLYADSVKGRFTISRDNAKTTLYLQM<br>NSLRPEDTAVYYCTIGGSLSRSSQGTLVTVSS |
| 18F05-<br>35GS-<br>17B05-<br>9GS-ALB8 | 176 | EVQLVESGGGLVQPGGSLRLSCVASGFTFSSYWMYWVRQAPGKG<br>VEWVSAISPGGVERYTDSVKGRFTISRDNAKNTLYLQMNSLKSED<br>TAMYYCARLTSFATPESQGTLVTVSSGGGGSGGGGSGGGGSGGG<br>GSGGGGSGGGGSGGGGSEVQLVESGGGLVQPGGSLRLSCAASGSI<br>GGLNAMAWYRQAPGKERELVAGIFGVGSTRYADSVKGRFTISRDI<br>AKNTVFLQMNSLNSEDTAVYYCRMSSVTRGSSDYWGQGTQVTV<br>SSGGGGSGGGSEVQLVESGGGLVQPGNSLRLSCAASGFTFSSFGM<br>SWVRQAPGKGLEWVSSISGSGSDTLYADSVKGRFTISRDNAKTTL<br>YLQMNSLRPEDTAVYYCTIGGSLSRSSQGTLVTVSS |
| 18F05-<br>35GS-<br>17E08-<br>9GS-ALB8 | 177 | EVQLVESGGGLVQPGGSLRLSCVASGFTFSSYWMYWVRQAPGKG<br>VEWVSAISPGGVERYTDSVKGRFTISRDNAKNTLYLQMNSLKSED<br>TAMYYCARLTSFATPESQGTLVTVSSGGGGSGGGGSGGGGSGGG<br>GSGGGGSGGGGSGGGGSEVQLVESGGGLVQPGGSLRLSCSASGSI<br>FGLNAMGWYRQTPGKERELVAGITSITRVGSTRYADSAKGRFTIS<br>GDYAKNTVYLQMNSLKPEDTGVYYCRMSIVKSGGADYWGQGTQ<br>VTVSSGGGGSGGGSEVQLVESGGGLVQPGNSLRLSCAASGFTFSS<br>FGMSWVRQAPGKGLEWVSSISGSGSDTLYADSVKGRFTISRDNAK<br>TTLYLQMNSLRPEDTAVYYCTIGGSLSRSSQGTLVTVSS |
| 17C08-<br>35GS-<br>18G11-<br>9GS-ALB8 | 178 | EVQLVESGGGLMQAGDSLRLSCAASGRAFSSYALGWFRRAPGKE<br>RECVAATDRLGDNTYFPDSVKGRFTISRDNAKNTLYLQMNNLKP<br>EDTAVYYCAAGAVRYGVSTSPMNYNYWGQGTQVTVSSGGGGSG<br>GGGSGGGGSGGGGSGGGGSGGGGSEVQLVESGGGLVQP<br>GGSLRLSCAASGTLFKINAMGWYRQAPGKRRELVALITSSDTTDY<br>AESVEGRFTISRDNTWNAVYLQMNSLKPEDTAVYYCHSDHYSMG<br>VPEKRVIMYGQGTQVTVSSGGGGSGGGSEVQLVESGGGLVQPGN<br>SLRLSCAASGFTFSSFGMSWVRQAPGKGLEWVSSISGSGSDTLYA<br>DSVKGRFTISRDNAKTTLYLQMNSLRPEDTAVYYCTIGGSLSRSSQ<br>GTLVTVSS |
| 17C08-<br>35GS-<br>34C07-<br>9GS-ALB8 | 179 | EVQLVESGGGLMQAGDSLRLSCAASGRAFSSYALGWFRRAPGKE<br>RECVAATDRLGDNTYFPDSVKGRFTISRDNAKNTLYLQMNNLKP<br>EDTAVYYCAAGAVRYGVSTSPMNYNYWGQGTQVTVSSGGGGSG<br>GGGSGGGGSGGGGSGGGGSGGGGSEVQLVESGGGLVQP<br>GGSLGLSCVASGSIFRINAMAWYRQAPGKQRELVAEITAGGSTNY<br>ADSVKGRFTISVDNAWNTLYLQMNSLKVEDTAVYYCNLDHYTT<br>WDRRSAYWGQGTQVTVSSGGGGSGGGSEVQLVESGGGLVQPGN<br>SLRLSCAASGFTFSSFGMSWVRQAPGKGLEWVSSISGSGSDTLYA<br>DSVKGRFTISRDNAKTTLYLQMNSLRPEDTAVYYCTIGGSLSRSSQ<br>GTLVTVSS |
| 17C08-<br>35GS-<br>17B05-<br>9GS-ALB8 | 180 | EVQLVESGGGLMQAGDSLRLSCAASGRAFSSYALGWFRRAPGKE<br>RECVAATDRLGDNTYFPDSVKGRFTISRDNAKNTLYLQMNNLKP<br>EDTAVYYCAAGAVRYGVSTSPMNYNYWGQGTQVTVSSGGGGSG<br>GGGSGGGGSGGGGSGGGGSGGGGSEVQLVESGGGLVQP<br>GGSLRLSCAASGSIGGLNAMAWYRQAPGKERELVAGIFGVGSTR<br>YADSVKGRFTISRDIAKNTVFLQMNSLNSEDTAVYYCRMSSVTRG<br>SSDYWGQGTQVTVSSGGGGSGGGSEVQLVESGGGLVQPGNSLRL<br>SCAASGFTFSSFGMSWVRQAPGKGLEWVSSISGSGSDTLYADSVK<br>GRFTISRDNAKTTLYLQMNSLRPEDTAVYYCTIGGSLSRSSQGTLV<br>TVSS |
| 17C08-<br>35GS-<br>17E08-<br>9GS-ALB8 | 181 | EVQLVESGGGLMQAGDSLRLSCAASGRAFSSYALGWFRRAPGKE<br>RECVAATDRLGDNTYFPDSVKGRFTISRDNAKNTLYLQMNNLKP<br>EDTAVYYCAAGAVRYGVSTSPMNYNYWGQGTQVTVSSGGGGSG<br>GGGSGGGGSGGGGSGGGGSGGGGSEVQLVESGGGLVQP<br>GGSLRLSCSASGSIFGLNAMGWYRQTPGKERELVAGITSITRVGST<br>RYADSAKGRFTISGDYAKNTVYLQMNSLKPEDTGVYYCRMSIVK |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | SGGADYWGQGTQVTVSSGGGGSGGGSEVQLVESGGGLVQPGNS LRLSCAASGFTFSSFGMSWVRQAPGKGLEWVSSISGSGSDTLYAD SVKGRFTISRDNAKTTLYLQMNSLRPEDTAVYYCTIGGSLSRSSQG TLVTVSS |
| 4C07-35GS-18F05-9GS-ALB8 | 182 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTQVTVSSGGGGSGGGGSGGGGSGGGG SGGGGSGGGGSGGGGSEVQLVESGGGLVQPGGSLRLSCVASGFTF SSYWMYWVRQAPGKGVEWVSAISPGGVERYTDSVKGRFTISRDN AKNTLYLQMNSLKSEDTAMYYCARLTSFATPESQGTQVTVSSGG GGSGGGSEVQLVESGGGLVQPGNSLRLSCAASGFTFSSFGMSWVR QAPGKGLEWVSSISGSGSDTLYADSVKGRFTISRDNAKTTLYLQM NSLRPEDTAVYYCTIGGSLSRSSQGTLVTVSS |
| 4C07-35GS-17B05-9GS-ALB8 | 183 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTQVTVSSGGGGSGGGGSGGGGSGGGG SGGGGSGGGGSGGGGSEVQLVESGGGLVQPGGSLRLSCAASGSIG GLNAMAWYRQAPGKERELVAGIFGVGSTRYADSVKGRFTISRDIA KNTVFLQMNSLNSEDTAVYYCRMSSVTRGSSDYWGQGTQVTVSS GGGGSGGGSEVQLVESGGGLVQPGNSLRLSCAASGFTFSSFGMS WVRQAPGKGLEWVSSISGSGSDTLYADSVKGRFTISRDNAKTTLY LQMNSLRPEDTAVYYCTIGGSLSRSSQGTLVTVSS |
| 4C07-35GS-17E08-9GS-ALB8 | 184 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTQVTVSSGGGGSGGGGSGGGGSGGGG SGGGGSGGGGSGGGGSEVQLVESGGGLVQPGGSLRLSCSASGSIF GLNAMGWYRQTPGKERELVAGITSITRVGSTRYADSAKGRFTISG DYAKNTVYLQMNSLKPEDTGVYYCRMSIVKSGGADYWGQGTQV TVSSGGGGSGGGSEVQLVESGGGLVQPGNSLRLSCAASGFTFSSF GMSWVRQAPGKGLEWVSSISGSGSDTLYADSVKGRFTISRDNAK TTLYLQMNSLRPEDTAVYYCTIGGSLSRSSQGTLVTVSS |
| 18G11-35GS-17C08-9GS-ALB8 | 185 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTQVTVSSGGGGSGGGGS GGGGSGGGGSGGGGSGGGGSEVQLVESGGGLMQAGDSL RLSCAASGRAFSSYALGWFRRAPGKERECVAATDRLGDNTYFPD SVKGRFTISRDNAKNTLYLQMNNLKPEDTAVYYCAAGAVRYGVS TSPMNYNYWGQGTQVTVSSGGGGSGGGSEVQLVESGGGLVQPG NSLRLSCAASGFTFSSFGMSWVRQAPGKGLEWVSSISGSGSDTLY ADSVKGRFTISRDNAKTTLYLQMNSLRPEDTAVYYCTIGGSLSRSS QGTLVTVSS |
| 18G11-35GS-34C07-9GS-ALB8 | 186 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTQVTVSSGGGGSGGGGS GGGGSGGGGSGGGGSGGGGSEVQLVESGGGLVQPGGSL GLSCVASGSIFRINAMAWYRQAPGKQRELVAEITAGGSTNYADSV KGRFTISVDNAWNTLYLQMNSLKVEDTAVYYCNLDHYTTWDRR SAYWGQGTQVTVSSGGGGSGGGSEVQLVESGGGLVQPGNSLRLS CAASGFTFSSFGMSWVRQAPGKGLEWVSSISGSGSDTLYADSVKG RFTISRDNAKTTLYLQMNSLRPEDTAVYYCTIGGSLSRSSQGTLVT VSS |
| 18G11-35GS-17B05-9GS-ALB8 | 187 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTQVTVSSGGGGSGGGGS GGGGSGGGGSGGGGSGGGGSEVQLVESGGGLVQPGGSL RLSCAASGSIGGLNAMAWYRQAPGKERELVAGIFGVGSTRYADS VKGRFTISRDIAKNTVFLQMNSLNSEDTAVYYCRMSSVTRGSSDY WGQGTQVTVSSGGGGSGGGSEVQLVESGGGLVQPGNSLRLSCAA SGFTFSSFGMSWVRQAPGKGLEWVSSISGSGSDTLYADSVKGRFTI SRDNAKTTLYLQMNSLRPEDTAVYYCTIGGSLSRSSQGTLVTVSS |
| 18G11-35GS-17E08- | 188 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTQVTVSSGGGGSGGGGS |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
| --- | --- | --- |
| 9GS-ALB8 | | GGGGSGGGGSGGGGSGGGGSGGGGSEVQLVESGGGLVQPGGSL RLSCSASGSIFGLNAMGWYRQTPGKERELVAGITSITRVGSTRYAD SAKGRFTISGDYAKNTVYLQMNSLKPEDTGVYYCRMSIVKSGGA DYWGQGTQVTVSSGGGGSGGGGSEVQLVESGGGLVQPGNSLRLSC AASGFTFSSFGMSWVRQAPGKGLEWVSSISGSGSDTLYADSVKGR FTISRDNAKTTLYLQMNSLRPEDTAVYYCTIGGSLSRSSQGTLVTV SS |
| 21F06-35GS-17B05-9GS-ALB8 | 189 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTQVTVSSGGGGS GGGGSGGGGSGGGGSGGGGSGGGGSEVQLVESGGGLVQP GGSLRLSCAASGSIGGLNAMAWYRQAPGKERELVAGIFGVGSTR YADSVKGRFTISRDIAKNTVFLQMNSLNSEDTAVYYCRMSSVTRG SSDYWGQGTQVTVSSGGGGSGGGSEVQLVESGGGLVQPGNSLRL SCAASGFTFSSFGMSWVRQAPGKGLEWVSSISGSGSDTLYADSVK GRFTISRDNAKTTLYLQMNSLRPEDTAVYYCTIGGSLSRSSQGTLV TVSS |
| 21F06-35GS-17E08-9GS-ALB8 | 190 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTQVTVSSGGGGSG GGGSGGGGSGGGGSGGGGSGGGGSGGGGSEVQLVESGGGLVQP GGSLRLSCSASGSIFGLNAMGWYRQTPGKERELVAGITSITRVGST RYADSAKGRFTISGDYAKNTVYLQMNSLKPEDTGVYYCRMSIVK SGGADYWGQGTQVTVSSGGGGSGGGGSEVQLVESGGGLVQPGNS LRLSCAASGFTFSSFGMSWVRQAPGKGLEWVSSISGSGSDTLYAD SVKGRFTISRDNAKTTLYLQMNSLRPEDTAVYYCTIGGSLSRSSQG TLVTVSS |
| 34C07-35GS-17C08-9GS-ALB8 | 191 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTQVTVSSGGGGSGGGGS GGGGSGGGGSGGGGSGGGGSGGGGSEVQLVESGGGLMQAGDSL RLSCAASGRAFSSYALGWFRRAPGKERECVAATDRLGDNTYFPD SVKGRFTISRDNAKNTLYLQMNNLKPEDTAVYYCAAGAVRYGVS TSPMNYNYWGQGTQVTVSSGGGGSGGGSEVQLVESGGGLVQPG NSLRLSCAASGFTFSSFGMSWVRQAPGKGLEWVSSISGSGSDTLY ADSVKGRFTISRDNAKTTLYLQMNSLRPEDTAVYYCTIGGSLSRSS QGTLVTVSS |
| 34C07-35GS-18G11-9GS-ALB8 | 192 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTQVTVSSGGGGSGGGGS GGGGSGGGGSGGGGSGGGGSGGGGSEVQLVESGGGLVQPGGSL RLSCAASGTLFKINAMGWYRQAPGKRRELVALITSSDTTDYAESV EGRFTISRDNTWNAVYLQMNSLKPEDTAVYYCHSDHYSMGVPEK RVIMYGQGTQVTVSSGGGGSGGGGSEVQLVESGGGLVQPGNSLRL SCAASGFTFSSFGMSWVRQAPGKGLEWVSSISGSGSDTLYADSVK GRFTISRDNAKTTLYLQMNSLRPEDTAVYYCTIGGSLSRSSQGTLV TVSS |
| 34C07-35GS-17B05-9GS-ALB8 | 193 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTQVTVSSGGGGSGGGGS GGGGSGGGGSGGGGSGGGGSGGGGSEVQLVESGGGLVQPGGSL RLSCAASGSIGGLNAMAWYRQAPGKERELVAGIFGVGSTRYADS VKGRFTISRDIAKNTVFLQMNSLNSEDTAVYYCRMSSVTRGSSDY WGQGTQVTVSSGGGGSGGGSEVQLVESGGGLVQPGNSLRLSCAA SGFTFSSFGMSWVRQAPGKGLEWVSSISGSGSDTLYADSVKGRFTI SRDNAKTTLYLQMNSLRPEDTAVYYCTIGGSLSRSSQGTLVTVSS |
| 34C07-35GS-17E08-9GS-ALB8 | 194 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTQVTVSSGGGGSGGGGS GGGGSGGGGSGGGGSGGGGSGGGGSEVQLVESGGGLVQPGGSL RLSCSASGSIFGLNAMGWYRQTPGKERELVAGITSITRVGSTRYAD SAKGRFTISGDYAKNTVYLQMNSLKPEDTGVYYCRMSIVKSGGA DYWGQGTQVTVSSGGGGSGGGSEVQLVESGGGLVQPGNSLRLSC AASGFTFSSFGMSWVRQAPGKGLEWVSSISGSGSDTLYADSVKGR |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | FTISRDNAKTTLYLQMNSLRPEDTAVYYCTIGGSLSRSSQGTLVTVSS |
| 17B05-35GS-4C07-9GS-ALB8 | 195 | EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| 17B05-35GS-17C08-9GS-ALB8 | 196 | EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| 17B05-35GS-18F05-9GS-ALB8 | 197 | EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| 17B05-35GS-18G11-9GS-ALB8 | 198 | EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| 17B05-35GS-21F06-9GS-ALB8 | 199 | EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| 17B05-35GS-34C07-9GS-ALB8 | 200 | EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| 17B05-35GS-17B05-9GS-ALB8 | 201 | EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSEVQLVESGGGLVQPGSLRLSCAASGSIGGLNAMAWYRQAPGKERELVAGIFGVGSTRYADSVKGRFTI |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | SRDIAKNTVFLQMNSLNSEDTAVYYCRMSSVTRGSSDYWGQGTQ VTVSSGGGGSGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSS |
| 17B05-35GS-17E08-9GS-ALB8 | 202 | EVQLVESGGGLVQPGGSLRLSCAASGSIGGLNAMAWYRQAPGKE RELVAGIFGVGSTRYADSVKGRFTISRDIAKNTVFLQMNSLNSEDT AVYYCRMSSVTRGSSDYWGQGTQVTVSSGGGGSGGGGSGGGGS GGGGSGGGGSGGGGSGGGGSEVQLVESGGGLVQPGGSLRLSCSA SGSIFGLNAMGWYRQTPGKERELVAGITSITRVGSTRYADSAKGR FTISGDYAKNTVYLQMNSLKPEDTGVYYCRMSIVKSGGADYWGQ GTQVTVSSGGGGSGGGSEVQLVESGGGLVQPGNSLRLSCAASGFT FSSFGMSWVRQAPGKGLEWVSSISGSGSDTLYADSVKGRFTISRD NAKTTLYLQMNSLRPEDTAVYYCTIGGSLSRSSQGTLVTVSS |
| 17E08-35GS-4C07-9GS-ALB8 | 203 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG GSGGGGSGGGGSGGGGSGGGGSEVQLVESGGGLVQAGGSLRLSC AASGFTFSSYPMSWVRQAPGKGPAWVSTVSPGGITTSYADSVKG RFTISRDNAKNTLYLQMNSLKPEDTAVYYCLRDLNNRGQGTQVT VSSGGGGSGGGSEVQLVESGGGLVQPGNSLRLSCAASGFTFSSFG MSWVRQAPGKGLEWVSSISGSGSDTLYADSVKGRFTISRDNAKTT LYLQMNSLRPEDTAVYYCTIGGSLSRSSQGTLVTVSS |
| 17E08-35GS-17C08-9GS-ALB8 | 204 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG GSGGGGSGGGGSGGGGSGGGGSEVQLVESGGGLMQAGDSLRLS CAASGRAFSSYALGWFRRAPGKERECVAATDRLGDNTYFPDSVK GRFTISRDNAKNTLYLQMNNLKPEDTAVYYCAAGAVRYGVSTSP MNYNYWGQGTQVTVSSGGGGSGGGSEVQLVESGGGLVQPGNSL RLSCAASGFTFSSFGMSWVRQAPGKGLEWVSSISGSGSDTLYADS VKGRFTISRDNAKTTLYLQMNSLRPEDTAVYYCTIGGSLSRSSQGT LVTVSS |
| 17E08-35GS-18F05-9GS-ALB8 | 205 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG GSGGGGSGGGGSGGGGSGGGGSEVQLVESGGGLVQPGGSLRLSC VASGFTFSSYWMYWVRQAPGKGVEWVSAISPGGVERYTDSVKG RFTISRDNAKNTLYLQMNSLKSEDTAMYYCARLTSFATPESQGTQ VTVSSGGGGSGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSS |
| 17E08-35GS-18G11-9GS-ALB8 | 206 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG GSGGGGSGGGGSGGGGSGGGGSEVQLVESGGGLVQPGGSLRLSC AASGTLFKINAMGWYRQAPGKRRELVALITSSDTTDYAESVEGRF TISRDNTWNAVYLQMNSLKPEDTAVYYCHSDHYSMGVPEKRVIM YGQGTQVTVSSGGGGSGGGSEVQLVESGGGLVQPGNSLRLSCAA SGFTFSSFGMSWVRQAPGKGLEWVSSISGSGSDTLYADSVKGRFTI SRDNAKTTLYLQMNSLRPEDTAVYYCTIGGSLSRSSQGTLVTVSS |
| 17E08-35GS-21F06-9GS-ALB8 | 207 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG GSGGGGSGGGGSGGGGSGGGGSEVQLVESGGGLVQAGGSLRLSC AASGRTYYLNAMGWFRQGPGKDREFVAAIDWSDGNKDYADSVK GRFTISRDNAKNTVYLQMNSLKPEDTAVYYCAADTPPWGPMIYIE SYDSWGQGTQVTVSSGGGGSGGGSEVQLVESGGGLVQPGNSLRL SCAASGFTFSSFGMSWVRQAPGKGLEWVSSISGSGSDTLYADSVK GRFTISRDNAKTTLYLQMNSLRPEDTAVYYCTIGGSLSRSSQGTLV TVSS |
| 17E08-35GS-34C07- | 208 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| 9GS-ALB8 | | GSGGGGSGGGGSGGGGSGGGGSEVQLVESGGGLVQPGGSLGLSC VASGSIFRINAMAWYRQAPGKQRELVAEITAGGSTNYADSVKGRF TISVDNAWNTLYLQMNSLKVEDTAVYYCNLDHYTTWDRRSAYW GQGTQVTVSSGGGGSGGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| 17E08-35GS-17B05-9GS-ALB8 | 209 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG GSGGGGSGGGGSGGGGSGGGGSEVQLVESGGGLVQPGGSLRLSC AASGSIGGLNAMAWYRQAPGKERELVAGIFGVGSTRYADSVKGR FTISRDIAKNTVFLQMNSLNSEDTAVYYCRMSSVTRGSSDYWGQG TQVTVSSGGGGSGGGSEVQLVESGGGLVQPGNSLRLSCAASGFTF SSFGMSWVRQAPGKGLEWVSSISGSGSDTLYADSVKGRFTISRDN AKTTLYLQMNSLRPEDTAVYYCTIGGSLSRSSQGTLVTVSS |
| 17E08-35GS-17E08-9GS-ALB8 | 210 | EVQLVESGGGLVQPGGSLRLSCSASGSIFGLNAMGWYRQTPGKER ELVAGITSITRVGSTRYADSAKGRFTISGDYAKNTVYLQMNSLKPE DTGVYYCRMSIVKSGGADYWGQGTQVTVSSGGGGSGGGGSGGG GSGGGGSGGGGSGGGGSGGGGSEVQLVESGGGLVQPGGSLRLSC SASGSIFGLNAMGWYRQTPGKERELVAGITSITRVGSTRYADSAK GRFTISGDYAKNTVYLQMNSLKPEDTGVYYCRMSIVKSGGADYW GQGTQVTVSSGGGGSGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| HER3MS00022 | 211 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQA GGSLRLSCAASGRTYYLNAMGWFRQGPGKDREFVAAIDWSDGN KDYADSVKGRFTISRDNAKNTVYLQMNSLKPEDTAVYYCAADTP PWGPMIYIESYDSWGQGTLVTVSSGGGGSGGGSEVQLVESGGGL VQPGNSLRLSCAASGFTFSSFGMSWVRQAPGKGLEWVSSISGSGS DTLYADSVKGRFTISRDNAKTTLYLQMNSLRPEDTAVYYCTIGGS LSRSSQGTLVTVSS |
| HER3MS00023 | 212 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQP GGSLGLSCVASGSIFRINAMAWYRQAPGKQRELVAEITAGGSTNY ADSVKGRFTISVDNAWNTLYLQMNSLKVEDTAVYYCNLDHYTT WDRRSAYWGQGTLVTVSSGGGGSGGGSEVQLVESGGGLVQPGN SLRLSCAASGFTFSSFGMSWVRQAPGKGLEWVSSISGSGSDTLYA DSVKGRFTISRDNAKTTLYLQMNSLRPEDTAVYYCTIGGSLSRSSQ GTLVTVSS |
| HER3MS00024 | 213 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQA GGSLRLSCAASGFTFSSYPMSWVRQAPGKGPAWVSTVSPGGITTS YADSVKGRFTISRDNAKNTLYLQMNSLKPEDTAVYYCLRDLNNR GQGTLVTVSSGGGGSGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| HER3MS00026 | 214 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTLVTVSSGGGGSGGGGSG GGGSGGGGSGGGGSGGGGSGGGGSEVQLVESGGGLVQAGGSLR LSCAASGRTYYLNAMGWFRQGPGKDREFVAAIDWSDGNKDYAD SVKGRFTISRDNAKNTVYLQMNSLKPEDTAVYYCAADTPPWGPM IYIESYDSWGQGTLVTVSSGGGGSGGGSEVQLVESGGGLVQPGNS LRLSCAASGFTFSSFGMSWVRQAPGKGLEWVSSISGSGSDTLYAD SVKGRFTISRDNAKTTLYLQMNSLRPEDTAVYYCTIGGSLSRSSQG TLVTVSS |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| HER3MS00028 | 215 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTLVTVSSGGGGSGGGGSG GGGSGGGGSGGGGSGGGGSGGGGSEVQLVESGGGLVQAGGSLR LSCAASGFTFSSYPMSWVRQAPGKGPAWVSTVSPGGITTSYADSV KGRFTISRDNAKNTLYLQMNSLKPEDTAVYYCLRDLNNRGQGTL VTVSSGGGGSGGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSS |
| HER3MS00030 | 216 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQAGGSLRLSCAASGRT YYLNAMGWFRQGPGKDREFVAAIDWSDGNKDYADSVKGRFTIS RDNAKNTVYLQMNSLKPEDTAVYYCAADTPPWGPMIYIESYDSW GQGTLVTVSSGGGGSGGGSEVQLVESGGGLVQPGNSLRLSCAAS GFTFSSFGMSWVRQAPGKGLEWVSSISGSGSDTLYADSVKGRFTIS RDNAKTTLYLQMNSLRPEDTAVYYCTIGGSLSRSSQGTLVTVSS |
| HER3MS00031 | 217 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQPGGSLGLSCVASGSIF RINAMAWYRQAPGKQRELVAEITAGGSTNYADSVKGRFTISVDN AWNTLYLQMNSLKVEDTAVYYCNLDHYTTWDRRSAYWGQGTL VTVSSGGGGSGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSS |
| HER3MS00032 | 218 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQAGGSLRLSCAASGFT FSSYPMSWVRQAPGKGPAWVSTVSPGGITTSYADSVKGRFTISRD NAKNTLYLQMNSLKPEDTAVYYCLRDLNNRGQGTLVTVSSGGG GSGGGSEVQLVESGGGLVQPGNSLRLSCAASGFTFSSFGMSWVRQ APGKGLEWVSSISGSGSDTLYADSVKGRFTISRDNAKTTLYLQMN SLRPEDTAVYYCTIGGSLSRSSQGTLVTVSS |
| HER3MS00034 | 219 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQP GGSLRLSCAASGTLFKINAMGWYRQAPGKRRELVALITSSDTTDY AESVEGRFTISRDNTWNAVYLQMNSLKPEDTAVYYCHSDHYSMG VPEKRVIMYGQGTLVTVSSGGGGSGGGSEVQLVESGGGLVQPGN SLRLSCAASGFTFSSFGMSWVRQAPGKGLEWVSSISGSGSDTLYA DSVKGRFTISRDNAKTTLYLQMNSLRPEDTAVYYCTIGGSLSRSSQ GTLVTVSS |
| HER3MS00035 | 220 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQPGGSLRLSCAASGTL FKINAMGWYRQAPGKRRELVALITSSDTTDYAESVEGRFTISRDN TWNAVYLQMNSLKPEDTAVYYCHSDHYSMGVPEKRVIMYGQGT LVTVSSGGGGSGGGSEVQLVESGGGLVQPGNSLRLSCAASGFTFS SFGMSWVRQAPGKGLEWVSSISGSGSDTLYADSVKGRFTISRDNA KTTLYLQMNSLRPEDTAVYYCTIGGSLSRSSQGTLVTVSS |
| HER3MS00037 | 221 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSEVQLVESGGGLVQPGGSL RLSCAASGTLFKINAMGWYRQAPGKRRELVALITSSDTTDYAESV EGRFTISRDNTWNAVYLQMNSLKPEDTAVYYCHSDHYSMGVPEK RVIMYGQGTLVTVSSGGGGSGGGSEVQLVESGGGLVQPGNSLRL SCAASGFTFSSFGMSWVRQAPGKGLEWVSSISGSGSDTLYADSVK |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | GRFTISRDNAKTTLYLQMNSLRPEDTAVYYCTIGGSLSRSSQGTLV TVSS |
| HER3MS00038 | 222 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSGGGGSEVQLVESGGGLVQAGGSL RLSCAASGRTYYLNAMGWFRQGPGKDREFVAAIDWSDGNKDYA DSVKGRFTISRDNAKNTVYLQMNSLKPEDTAVYYCAADTPPWGP MIYIESYDSWGQGTLVTVSSGGGGSGGGGSEVQLVESGGGLVQPG NSLRLSCAASGFTFSSFGMSWVRQAPGKGLEWVSSISGSGSDTLY ADSVKGRFTISRDNAKTTLYLQMNSLRPEDTAVYYCTIGGSLSRSS QGTLVTVSS |
| HER3MS00039 | 223 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSGGGGSEVQLVESGGGLVQAGGSL RLSCAASGFTFSSYPMSWVRQAPGKGPAWVSTVSPGGITTSYADS VKGRFTISRDNAKNTLYLQMNSLKPEDTAVYYCLRDLNNRGQGT LVTVSSGGGGSGGGSEVQLVESGGGLVQPGNSLRLSCAASGFTFS SFGMSWVRQAPGKGLEWVSSISGSGSDTLYADSVKGRFTISRDNA KTTLYLQMNSLRPEDTAVYYCTIGGSLSRSSQGTLVTVSS |
| HER3MS00042 | 224 | EVQLVESGGGLVQPGGSLRLSCAASGFTFSSYPMSWVRQAPGKGP AWVSTVSPGGITTSYADSVKGRFTISRDNSKNTLYLQMNSLRPED TAVYYCLRDLNNRGQGTLVTVSSAAAEQKLISEEDLNGAAHHHH HH |
| HER3MS00043 | 225 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCLRDLNNRGQGTLVTVSSAAAEQKLISEEDLNGAAHHHHHH |
| HER3MS00044 | 226 | EVQLVESGGGLVQPGGSLRLSCAASGFTFSSYPMSWVRQAPGKGP AWVSTVSPGGITTSYADSVKGRFTISRDNSKNTLYLQMNSLRPED TAVYYCARDLNNRGQGTLVTVSSAAAEQKLISEEDLNGAAHHHH HH |
| HER3MS00045 | 227 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCARDLNNRGQGTLVTVSSAAAEQKLISEEDLNGAAHHHHHH |
| HER3MS00046 | 228 | EVQLVESGGGLVQPGGSLRLSCAASGRTYYLNAMGWFRQGPGK DREFVAAIDWSDGNKDYADSVKGRFTISRDNSKNTVYLQMNSLR PEDTAVYYCAADTPPWGPMIYIESYDSWGQGTLVTVSSAAAEQK LISEEDLNGAAHHHHHH |
| HER3MS00047 | 229 | EVQLVESGGGLVQPGGSLRLSCAASGRTYYLNAMGWFRQGPGK DREFVAAIDWSDGNKDYADSVKGRFTISRDNSKNTVYLQMNSLR PEDTAVYYCAADTPPWGPMIYIESYDSWGQGTLVTVSSAAAEQK LISEEDLNGAAHHHHHH |
| HER3MS00048 | 230 | EVQLVESGGGLVQPGGSLRLSCAASGRTYYLNAMGWFRQGPGKE REFVAAIDWSDGNKDYADSVKGRFTISRDNSKNTVYLQMNSLRP EDTAVYYCAADTPPWGPMIYIESYDSWGQGTLVTVSSAAAEQKLI SEEDLNGAAHHHHHH |
| HER3MS00049 | 231 | EVQLVESGGGLVQPGGSLRLSCAASGRTYYLNAMGWFRQGPGKE REFVAAIDWSDGNKDYADSVKGRFTISRDNSKNTVYLQMNSLRP EDTAVYYCAADTPPWGPMIYIESYDSWGQGTLVTVSSAAAEQKLI SEEDLNGAAHHHHHH |
| HER3MS00051 | 232 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTLVTVSSGGGGSGGGGSG GGGSGGGGSGGGGSGGGGSGGGGSEVQLVESGGGLVQPGGSLRL SCAASGSIGGLNAMAWYRQAPGKERELVAGIFGVGSTRYADSVK GRFTISRDIAKNTVFLQMNSLNSEDTAVYYCRMSSVTRGSSDYWG QGTLVTVSSGGGGSGGGSEVQLVESGGGLVQPGNSLRLSCAASGF |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | TFSSFGMSWVRQAPGKGLEWVSSISGSGSDTLYADSVKGRFTISR DNAKTTLYLQMNSLRPEDTAVYYCTIGGSLSRSSQGTLVTVSS |
| HER3MS00052 | 233 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTLVTVSSGGGGSGGGGS GGGGSGGGGSGGGGSGGGGSEVQLVESGGGLVQPGGSL RLSCAASGSIGGLNAMAWYRQAPGKERELVAGIFGVGSTRYADS VKGRFTISRDIAKNTVFLQMNSLNSEDTAVYYCRMSSVTRGSSDY WGQGTLVTVSSGGGGSGGGSEVQLVESGGGLVQPGNSLRLSCAA SGFTFSSFGMSWVRQAPGKGLEWVSSISGSGSDTLYADSVKGRFTI SRDNAKTTLYLQMNSLRPEDTAVYYCTIGGSLSRSSQGTLVTVSS |
| HER3MS00054 | 234 | EVQLVESGGGLVQPGGSLRLSCAASGSIGGLNAMAWYRQAPGKE RELVAGIFGVGSTRYADSVKGRFTISRDIAKNTVFLQMNSLNSEDT AVYYCRMSSVTRGSSDYWGQGTLVTVSSGGGGSGGGGSGGGGS GGGGSGGGGSGGGGSGGGGSEVQLVESGGGLVQPGGSLGLSCVA SGSIFRINAMAWYRQAPGKQRELVAEITAGGSTNYADSVKGRFTI SVDNAWNTLYLQMNSLKVEDTAVYYCNLDHYTTWDRRSAYWG QGTLVTVSSGGGGSGGGSEVQLVESGGGLVQPGNSLRLSCAASGF TFSSFGMSWVRQAPGKGLEWVSSISGSGSDTLYADSVKGRFTISR DNAKTTLYLQMNSLRPEDTAVYYCTIGGSLSRSSQGTLVTVSS |
| HER3MS00055 | 235 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTLVTVSSGGGGSGGGGSGGGGSGGGG SGGGGSGGGGSGGGGSEVQLVESGGGLVQPGGSLRLSCAASGSIG GLNAMAWYRQAPGKERELVAGIFGVGSTRYADSVKGRFTISRDIA KNTVFLQMNSLNSEDTAVYYCRMSSVTRGSSDYWGQGTLVTVSS GGGGSGGGSEVQLVESGGGLVQPGNSLRLSCAASGFTFSSFGMS WVRQAPGKGLEWVSSISGSGSDTLYADSVKGRFTISRDNAKTTLY LQMNSLRPEDTAVYYCTIGGSLSRSSQGTLVTVSS |
| HER3MS00056 | 236 | EVQLVESGGGLVQPGGSLRLSCAASGSIGGLNAMAWYRQAPGKE RELVAGIFGVGSTRYADSVKGRFTISRDIAKNTVFLQMNSLNSEDT AVYYCRMSSVTRGSSDYWGQGTLVTVSSGGGGSGGGGSGGGGS GGGGSGGGGSGGGGSGGGGSEVQLVESGGGLVQPGGSLRLSCAA SGSIGGLNAMAWYRQAPGKERELVAGIFGVGSTRYADSVKGRFTI SRDIAKNTVFLQMNSLNSEDTAVYYCRMSSVTRGSSDYWGQGTL VTVSSGGGGSGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSS |
| HER3MS00057 | 237 | EVQLVESGGGLVQPGGSLRLSCAASGSIGGLNAMAWYRQAPGKE RELVAGIFGVGSTRYADSVKGRFTISRDIAKNTVFLQMNSLNSEDT AVYYCRMSSVTRGSSDYWGQGTLVTVSSGGGGSGGGGSGGGGS GGGGSGGGGSGGGGSGGGGSEVQLVESGGGLVQAGGSLRLSCA ASGFTFSSYPMSWVRQAPGKGPAWVSTVSPGGITTSYADSVKGRF TISRDNAKNTLYLQMNSLKPEDTAVYYCLRDLNNRGQGTLVTVS SGGGGSGGGSEVQLVESGGGLVQPGNSLRLSCAASGFTFSSFGMS WVRQAPGKGLEWVSSISGSGSDTLYADSVKGRFTISRDNAKTTLY LQMNSLRPEDTAVYYCTIGGSLSRSSQGTLVTVSS |
| HER3MS00058 | 238 | EVQLVESGGGLVQPGGSLRLSCAASGSIGGLNAMAWYRQAPGKE RELVAGIFGVGSTRYADSVKGRFTISRDIAKNTVFLQMNSLNSEDT AVYYCRMSSVTRGSSDYWGQGTLVTVSSGGGGSGGGGSGGGGS GGGGSGGGGSGGGGSGGGGSEVQLVESGGGLVQPGGSLRLSCAA SGTLFKINAMGWYRQAPGKRRELVALITSSDTTDYAESVEGRFTIS RDNTWNAVYLQMNSLKPEDTAVYYCHSDHYSMGVPEKRVIMYG QGTLVTVSSGGGGSGGGSEVQLVESGGGLVQPGNSLRLSCAASGF TFSSFGMSWVRQAPGKGLEWVSSISGSGSDTLYADSVKGRFTISR DNAKTTLYLQMNSLRPEDTAVYYCTIGGSLSRSSQGTLVTVSS |
| HER3MS00060 | 239 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTLVTVSSGGGGSG GGGSGGGGSGGGGSGGGGSGGGGSEVQLVESGGGLVQP GGSLRLSCAASGSIGGLNAMAWYRQAPGKERELVAGIFGVGSTR YADSVKGRFTISRDIAKNTVFLQMNSLNSEDTAVYYCRMSSVTRG SSDYWGQGTLVTVSSGGGGSGGGSEVQLVESGGGLVQPGNSLRL |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | SCAASGFTFSSFGMSWVRQAPGKGLEWVSSISGSGSDTLYADSVK GRFTISRDNAKTTLYLQMNSLRPEDTAVYYCTIGGSLSRSSQGTLV TVSS |
| HER3MS00061 | 240 | EVQLVESGGGLVQPGGSLRLSCAASGSIGGLNAMAWYRQAPGKE RELVAGIFGVGSTRYADSVKGRFTISRDIAKNTVFLQMNSLNSEDT AVYYCRMSSVTRGSSDYWGQGTLVTVSSGGGGSGGGGSGGGGS GGGGSGGGGSGGGGSGGGGSEVQLVESGGGLVQAGGSLRLSCA ASGRTYYLNAMGWFRQGPGKDREFVAAIDWSDGNKDYADSVKG RFTISRDNAKNTVYLQMNSLKPEDTAVYYCAADTPPWGPMIYIES YDSWGQGTLVTVSSGGGGSGGGGSEVQLVESGGGLVQPGNSLRLS CAASGFTFSSFGMSWVRQAPGKGLEWVSSISGSGSDTLYADSVKG RFTISRDNAKTTLYLQMNSLRPEDTAVYYCTIGGSLSRSSQGTLVT VSS |
| HER3MS00068 | 241 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSGGVPEKRVIMYGQGTLVTVSSAAAEQKLISEED LNGAAHHHHHH |
| HER3MS00069 | 242 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSLGVPEKRVIMYGQGTLVTVSSAAAEQKLISEED LNGAAHHHHHH |
| HER3MS00070 | 243 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSIGVPEKRVIMYGQGTLVTVSSAAAEQKLISEED LNGAAHHHHHH |
| HER3MS00071 | 244 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSVGVPEKRVIMYGQGTLVTVSSAAAEQKLISEED LNGAAHHHHHH |
| HER3MS00072 | 245 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVILYGQGTLVTVSSAAAEQKLISEED LNGAAHHHHHH |
| HER3MS00073 | 246 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIDYGQGTLVTVSSAAAEQKLISEED LNGAAHHHHHH |
| HER3MS00074 | 247 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIEYGQGTLVTVSSAAAEQKLISEED LNGAAHHHHHH |
| HER3MS00076 | 248 | EVQLVESGGGLVQPGGSLRLSCAASGSIGGLNAMAWYRQAPGKE RELVAGIFGVGSTRYADSVKGRFTISRDISKNTVFLQMNSLRSEDT AVYYCRMSSVTRGSSDYWGQGTLVTVSSAAAEQKLISEEDLNGA AHHHHHH |
| HER3MS00077 | 249 | EVQLVESGGGLVQPGGSLRLSCAASGSIGGLNAMAWYRQAPGKE RELVAGIFGVGSTRYADSVKGRFTISRDNSKNTVFLQMNSLRSED TAVYYCRMSSVTRGSSDYWGQGTLVTVSSAAAEQKLISEEDLNG AAHHHHHH |
| HER3MS00078 | 250 | EVQLVESGGGLVQPGGSLRLSCAASGSIGGLNAMAWYRQAPGKE RELVAGIFGVGSTRYADSVKGRFTISRDISKNTVYLQMNSLRSEDT AVYYCRMSSVTRGSSDYWGQGTLVTVSSAAAEQKLISEEDLNGA AHHHHHH |
| HER3MS00079 | 251 | EVQLVESGGGLVQPGGSLRLSCAASGSIGGLNAMAWYRQAPGKE RELVAGIFGVGSTRYADSVKGRFTISRDISKNTVFLQMNSLRSEDT AVYYCAMSSVTRGSSDYWGQGTLVTVSSAAAEQKLISEEDLNGA AHHHHHH |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| HER3MS00080 | 252 | EVQLVESGGGLVQPGGSLRLSCAASGSIGGLNAMAWYRQAPGKE RELVAGIFGVGSTRYADSVKGRFTISRDNSKNTVYLQMNSLRSED TAVYYCRMSSVTRGSSDYWGQGTLVTVSSAAAEQKLISEEDLNG AAHHHHHH |
| HER3MS00081 | 253 | EVQLVESGGGLVQPGGSLRLSCAASGSIGGLNAMAWYRQAPGKE RELVAGIFGVGSTRYADSVKGRFTISRDNSKNTVFLQMNSLRSED TAVYYCAMSSVTRGSSDYWGQGTLVTVSSAAAEQKLISEEDLNG AAHHHHHH |
| HER3MS00082 | 254 | EVQLVESGGGLVQPGGSLRLSCAASGSIGGLNAMAWYRQAPGKE RELVAGIFGVGSTRYADSVKGRFTISRDISKNTVYLQMNSLRSEDT AVYYCAMSSVTRGSSDYWGQGTLVTVSSAAAEQKLISEEDLNGA AHHHHHH |
| HER3MS00083 | 255 | EVQLVESGGGLVQPGGSLRLSCAASGSIGGLNAMAWYRQAPGKE RELVAGIFGVGSTRYADSVKGRFTISRDNSKNTVYLQMNSLRSED TAVYYCAMSSVTRGSSDYWGQGTLVTVSSAAAEQKLISEEDLNG AAHHHHHH |
| HER3MS00084 | 256 | EVQLVESGGGLVQPGGSLRLSCAASGSIGGLNAMAWYRQAPGKE RELVAGIFGVGSTRYADSVKGRFTISRDISKNTVFLQMNSLRPEDT AVYYCRMSSVTRGSSDYWGQGTLVTVSSAAAEQKLISEEDLNGA AHHHHHH |
| HER3MS00085 | 257 | EVQLVESGGGLVQPGGSLRLSCAASGSIGGLNAMAWYRQAPGKE RELVAGIFGVGSTRYADSVKGRFTISRDISKNTVFLQMNSLRAEDT AVYYCRMSSVTRGSSDYWGQGTLVTVSSAAAEQKLISEEDLNGA AHHHHHH |
| HER3MS00088 | 258 | EVQLVESGGGLVQAGGSLRLSCAASGRTYYLNAMGWFRQGPGK DREFVAAIDWSYGNKDYADSVKGRFTISRDNAKNTVYLQMNSLK PEDTAVYYCAADTPPWGPMIYIESYDSWGQGTLVTVSSAAAEQK LISEEDLNGAAHHHHHH |
| HER3MS00089 | 259 | EVQLVESGGGLVQAGGSLRLSCAASGRTYYLNAMGWFRQGPGK DREFVAAIDWSEGNKDYADSVKGRFTISRDNAKNTVYLQMNSLK PEDTAVYYCAADTPPWGPMIYIESYDSWGQGTLVTVSSAAAEQK LISEEDLNGAAHHHHHH |
| HER3MS00090 | 260 | EVQLVESGGGLVQAGGSLRLSCAASGRTYYLNAMGWFRQGPGK DREFVAAIDWSDANKDYADSVKGRFTISRDNAKNTVYLQMNSLK PEDTAVYYCAADTPPWGPMIYIESYDSWGQGTLVTVSSAAAEQK LISEEDLNGAAHHHHHH |
| HER3MS00091 | 261 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPFIYIESYDSWGQGTLVTVSSAAAEQKL ISEEDLNGAAHHHHHH |
| HER3MS00092 | 262 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPYIYIESYDSWGQGTLVTVSSAAAEQKL ISEEDLNGAAHHHHHH |
| HER3MS00093 | 263 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPLIYIESYDSWGQGTLVTVSSAAAEQKL ISEEDLNGAAHHHHHH |
| HER3MS00094 | 264 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYQSWGQGTLVTVSSAAAEQK LISEEDLNGAAHHHHHH |
| HER3MS00095 | 265 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYESWGQGTLVTVSSAAAEQK LISEEDLNGAAHHHHHH |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
| --- | --- | --- |
| HER3MS00096 | 266 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDDWGQGTLVTVSSAAAEQK LISEEDLNGAAHHHHHH |
| HER3MS00097 | 267 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDEWGQGTLVTVSSAAAEQK LISEEDLNGAAHHHHHH |
| HER3MS00098 | 268 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDTWGQGTLVTVSSAAAEQK LISEEDLNGAAHHHHHH |
| HER3MS00118 | 269 | EVQLVESGGGLVQPGGSLRLSCAASGSIGGLNAMAWYRQAPGKE RELVAGIFGVGSTRYADSVKGRFTISRDNSKNTVYLQMNSLRAED TAVYYCRMSSVTRGSSDYWGQGTLVTVSSAAAEQKLISEEDLNG AAHHHHHH |
| HER3MS00119 | 270 | EVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSAAAEQKLISEEDLNG AAHHHHHH |
| HER3MS00120 | 271 | DVQLVESGGGLVQPGGSLRLSCAASGSIGGLNAMAWYRQAPGKE RELVAGIFGVGSTRYADSVKGRFTISRDNSKNTVYLQMNSLRAED TAVYYCRMSSVTRGSSDYWGQGTLVTVSSAAAEQKLISEEDLNG AAHHHHHH |
| HER3MS00121 | 272 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSAAAEQKLISEEDLNG AAHHHHHH |
| HER3MS00123 | 273 | EVQLVESGGGLVQPGGSLRLSCAASGSIFRINAMAWYRQAPGKQ RELVAEITAGGSTNYADSVKGRFTISRDNSWNTLYLQMNSLRPED TAVYYCNLDHYTTWDRRSAYWGQGTLVTVSSAAAEQKLISEEDL NGAAHHHHHH |
| HER3MS00124 | 274 | EVQLVESGGGLVQPGGSLRLSCAASGSIFRINAMAWYRQAPGKQ RELVAEITAGGSTNYADSVKGRFTISRDNSWNTLYLQMNSLRAED TAVYYCNLDHYTTWDRRSAYWGQGTLVTVSSAAAEQKLISEEDL NGAAHHHHHH |
| HER3MS00125 | 275 | EVQLVESGGGLVQPGGSLRLSCAASGTLFKINAMGWYRQAPGKQ RELVALITSSDTTDYAEDVKGRFTISRDNSWNTVYLQMNSLRPED TAVYYCHSDHYSLGVPEKRVILYGQGTLVTVSSAAAEQKLISEED LNGAAHHHHHH |
| HER3MS00127 | 276 | DVQLVESGGGLVQPGGSLRLSCAASGSIFRINAMAWYRQAPGKQ RELVAEITAGGSTNYADSVKGRFTISRDNSWNTLYLQMNSLRPED TAVYYCNLDHYTTWDRRSAYWGQGTLVTVSSAAAEQKLISEEDL NGAAHHHHHH |
| HER3MS00128 | 277 | DVQLVESGGGLVQPGGSLRLSCAASGSIFRINAMAWYRQAPGKQ RELVAEITAGGSTNYADSVKGRFTISRDNSWNTLYLQMNSLRAED TAVYYCNLDHYTTWDRRSAYWGQGTLVTVSSAAAEQKLISEEDL NGAAHHHHHH |
| HER3MS00129 | 278 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCLRDLGNRGQGTLVTVSSAAAEQKLISEEDLNGAAHHHHHH |
| HER3MS00130 | 279 | EVQLVESGGGLVQPGGSLRLSCAASGFTFSSYPMSWVRQAPGKGP AWVSTVSPGGITTSYADSVKGRFTISRDNSKNTLYLQMNSLRPED TAVYYCLRDLGNRGQGTLVTVSSAAAEQKLISEEDLNGAAHHHH HH |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
| --- | --- | --- |
| HER3MS00131 | 280 | EVQLVESGGGLVQPGGSLRLSCAASGFTFSSYPMSWVRQAPGKGP<br>EWVSTVSPGGITTSYADSVKGRFTISRDNSKNTLYLQMNSLRPEDT<br>AVYYCLRDLSNRGQGTLVTVSSAAAEQKLISEEDLNGAAHHHHHH |
| HER3MS00132 | 281 | EVQLVESGGGLVQPGGSLRLSCAASGFTFSSYPMSWVRQAPGKGP<br>AWVSTVSPGGITTSYADSVKGRFTISRDNSKNTLYLQMNSLRPED<br>TAVYYCLRDLSNRGQGTLVTVSSAAAEQKLISEEDLNGAAHHHH<br>HH |
| HER3MS00135 | 282 | DVQLVESGGGLVQPGGSLRLSCAASGSIGGLNAMAWYRQAPGKE<br>RELVAGIFGVGSTRYADSVKGRFTISRDNSKNTVYLQMNSLRPED<br>TAVYYCRMSSVTRGSSDYWGQGTLVTVSSGGGGSGGGGSEVQLVE<br>SGGGLVQPGNSLRLSCAASGFTFSSFGMSWVRQAPGKGLEWVSSI<br>SGSGSDTLYADSVKGRFTISRDNAKTTLYLQMNSLRPEDTAVYYC<br>TIGGSLSRSSQGTLVTVSSGGGGSGGGGSEVQLVESGGGLVQPGGS<br>LRLSCAASGRTYYLNAMGWFRQAPGKEREFVAAIDWSEGNKDY<br>ADSVKGRFTISRDNSKNTVYLQMNSLRPEDTAVYYCAADTPPWG<br>PLIYIESYDSWGQGTLVTVSS |
| HER3MS00136 | 283 | DVQLVESGGGLVQPGGSLRLSCAASGSIGGLNAMAWYRQAPGKE<br>RELVAGIFGVGSTRYADSVKGRFTISRDNSKNTVYLQMNSLRPED<br>TAVYYCRMSSVTRGSSDYWGQGTLVTVSSGGGGSGGGGSGGGG<br>SGGGGSGGGGSGGGGSGGGGSEVQLVESGGGLVQPGNSLRLSCA<br>ASGFTFSSFGMSWVRQAPGKGLEWVSSISGSGSDTLYADSVKGRF<br>TISRDNAKTTLYLQMNSLRPEDTAVYYCTIGGSLSRSSQGTLVTVS<br>SGGGGSGGGGSGGGGSGGGGSGGGGSGGGGSGGGGSEVQLVES<br>GGGLVQPGGSLRLSCAASGRTYYLNAMGWFRQAPGKEREFVAAI<br>DWSEGNKDYADSVKGRFTISRDNSKNTVYLQMNSLRPEDTAVYY<br>CAADTPPWGPLIYIESYDSWGQGTLVTVSS |
| HER3MS00137 | 284 | DVQLVESGGGLVQPGGSLRLSCAASGSIGGLNAMAWYRQAPGKE<br>RELVAGIFGVGSTRYADSVKGRFTISRDNSKNTVYLQMNSLRPED<br>TAVYYCRMSSVTRGSSDYWGQGTLVTVSSGGGGSGGGGSEVQLVE<br>SGGGLVQPGGSLRLSCAASGRTYYLNAMGWFRQAPGKEREFVAA<br>IDWSEGNKDYADSVKGRFTISRDNSKNTVYLQMNSLRPEDTAVY<br>YCAADTPPWGPLIYIESYDSWGQGTLVTVSSGGGGSGGGGSEVQLV<br>ESGGGLVQPGNSLRLSCAASGFTFSSFGMSWVRQAPGKGLEWVS<br>SISGSGSDTLYADSVKGRFTISRDNAKTTLYLQMNSLRPEDTAVY<br>YCTIGGSLSRSSQGTLVTVSS |
| HER3MS00138 | 285 | DVQLVESGGGLVQPGGSLRLSCAASGSIGGLNAMAWYRQAPGKE<br>RELVAGIFGVGSTRYADSVKGRFTISRDNSKNTVYLQMNSLRPED<br>TAVYYCRMSSVTRGSSDYWGQGTLVTVSSGGGGSGGGGSGGGG<br>SGGGGSGGGGSGGGGSGGGGSEVQLVESGGGLVQPGGSLRLSCA<br>ASGRTYYLNAMGWFRQAPGKEREFVAAIDWSEGNKDYADSVKG<br>RFTISRDNSKNTVYLQMNSLRPEDTAVYYCAADTPPWGPLIYIESY<br>DSWGQGTLVTVSSGGGGSGGGGSGGGGSGGGGSGGGGSGGGGS<br>GGGGSEVQLVESGGGLVQPGNSLRLSCAASGFTFSSFGMSWVRQ<br>APGKGLEWVSSISGSGSDTLYADSVKGRFTISRDNAKTTLYLQMN<br>SLRPEDTAVYYCTIGGSLSRSSQGTLVTVSS |
| HER3MS00139 | 286 | DVQLVESGGGLVQPGGSLRLSCAASGSIGGLNAMAWYRQAPGKE<br>RELVAGIFGVGSTRYADSVKGRFTISRDNSKNTVYLQMNSLRPED<br>TAVYYCRMSSVTRGSSDYWGQGTLVTVSSGGGGSGGGGSEVQLVE<br>SGGGLVQPGNSLRLSCAASGFTFSSFGMSWVRQAPGKGLEWVSSI<br>SGSGSDTLYADSVKGRFTISRDNAKTTLYLQMNSLRPEDTAVYYC<br>TIGGSLSRSSQGTLVTVSSGGGGSGGGGSEVQLVESGGGLVQPGGS<br>LRLSCAASGSIFRINAMAWYRQAPGKQRELVAEITAGGSTNYADS<br>VKGRFTISRDNSWNTLYLQMNSLRPEDTAVYYCNLDHYTTWDRR<br>SAYWGQGTLVTVSS |
| HER3MS00140 | 287 | DVQLVESGGGLVQPGGSLRLSCAASGSIGGLNAMAWYRQAPGKE<br>RELVAGIFGVGSTRYADSVKGRFTISRDNSKNTVYLQMNSLRPED<br>TAVYYCRMSSVTRGSSDYWGQGTLVTVSSGGGGSGGGGSGGGG<br>SGGGGSGGGGSGGGGSGGGGSEVQLVESGGGLVQPGNSLRLSCA<br>ASGFTFSSFGMSWVRQAPGKGLEWVSSISGSGSDTLYADSVKGRF<br>TISRDNAKTTLYLQMNSLRPEDTAVYYCTIGGSLSRSSQGTLVTVS<br>SGGGGSGGGGSGGGGSGGGGSGGGGSGGGGSGGGGSEVQLVES<br>GGGLVQPGGSLRLSCAASGSIFRINAMAWYRQAPGKQRELVAEIT |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | AGGSTNYADSVKGRFTISRDNSWNTLYLQMNSLRPEDTAVYYCN LDHYTTWDRRSAYWGQGTLVTVSS |
| HER3MS00141 | 288 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGGSEVQLVE SGGGLVQPGGSLRLSCAASGSIFRINAMAWYRQAPGKQRELVAEI TAGGSTNYADSVKGRFTISRDNSWNTLYLQMNSLRPEDTAVYYC NLDHYTTWDRRSAYWGQGTLVTVSSGGGGSGGGGSEVQLVESGG GLVQPGNSLRLSCAASGFTFSSFGMSWVRQAPGKGLEWVSSISGS GSDTLYADSVKGRFTISRDNAKTTLYLQMNSLRPEDTAVYYCTIG GSLSRSSQGTLVTVSS |
| HER3MS00142 | 289 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGGSGGGG SGGGGSGGGGSGGGGSGGGGSEVQLVESGGGLVQPGGSLRLSCA ASGSIFRINAMAWYRQAPGKQRELVAEITAGGSTNYADSVKGRFT ISRDNSWNTLYLQMNSLRPEDTAVYYCNLDHYTTWDRRSAYWG QGTLVTVSSGGGGSGGGGSGGGGSGGGGSGGGGSGGGGSGGGG SEVQLVESGGGLVQPGNSLRLSCAASGFTFSSFGMSWVRQAPGKG LEWVSSISGSGSDTLYADSVKGRFTISRDNAKTTLYLQMNSLRPED TAVYYCTIGGSLSRSSQGTLVTVSS |
| HER3MS00143 | 290 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGGSEVQLVE SGGGLVQPGNSLRLSCAASGFTFSSFGMSWVRQAPGKGLEWVSSI SGSGSDTLYADSVKGRFTISRDNAKTTLYLQMNSLRPEDTAVYYC TIGGSLSRSSQGTLVTVSSGGGGSGGGGSEVQLVESGGGLVQPGGS LRLSCAASGTLFKINAMGWYRQAPGKRRELVALITSSDTTDYAED VKGRFTISRDNSWNTVYLQMNSLRPEDTAVYYCHSDHYSLGVPE KRVILYGQGTLVTVSS |
| HER3MS00144 | 291 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGGSGGGG SGGGGSGGGGSGGGGSGGGGSEVQLVESGGGLVQPGNSLRLSCA ASGFTFSSFGMSWVRQAPGKGLEWVSSISGSGSDTLYADSVKGRF TISRDNAKTTLYLQMNSLRPEDTAVYYCTIGGSLSRSSQGTLVTVS SGGGGSGGGGSGGGGSGGGGSGGGGSGGGGSGGGGSEVQLVES GGGLVQPGGSLRLSCAASGTLFKINAMGWYRQAPGKRRELVALI TSSDTTDYAEDVKGRFTISRDNSWNTVYLQMNSLRPEDTAVYYC HSDHYSLGVPEKRVILYGQGTLVTVSS |
| HER3MS00145 | 292 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGGSEVQLVE SGGGLVQPGGSLRLSCAASGTLFKINAMGWYRQAPGKRRELVALI TSSDTTDYAEDVKGRFTISRDNSWNTVYLQMNSLRPEDTAVYYC HSDHYSLGVPEKRVILYGQGTLVTVSSGGGGSGGGGSEVQLVESGG GLVQPGNSLRLSCAASGFTFSSFGMSWVRQAPGKGLEWVSSISGS GSDTLYADSVKGRFTISRDNAKTTLYLQMNSLRPEDTAVYYCTIG GSLSRSSQGTLVTVSS |
| HER3MS00146 | 293 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGGSGGGG SGGGGSGGGGSGGGGSGGGGSEVQLVESGGGLVQPGGSLRLSCA ASGTLFKINAMGWYRQAPGKRRELVALITSSDTTDYAEDVKGRFT ISRDNSWNTVYLQMNSLRPEDTAVYYCHSDHYSLGVPEKRVILY GQGTLVTVSSGGGGSGGGGSGGGGSGGGGSGGGGSGGGGSGGGG SEVQLVESGGGLVQPGNSLRLSCAASGFTFSSFGMSWVRQAPGK GLEWVSSISGSGSDTLYADSVKGRFTISRDNAKTTLYLQMNSLRPE DTAVYYCTIGGSLSRSSQGTLVTVSS |
| HER3MS00147 | 294 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCLRDLGNRGQGTLVTVSSGGGGSGGGGSGGGGSGGGGSG GGGSGGGGSGGGGSEVQLVESGGGLVQPGNSLRLSCAASGFTFSS |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | FGMSWVRQAPGKGLEWVSSISGSGSDTLYADSVKGRFTISRDNAK<br>TTLYLQMNSLRPEDTAVYYCTIGGSLSRSSQGTLVTVSSGGGGSG<br>GGGSGGGGSGGGGSGGGGSGGGGSGGGGSEVQLVESGGGLVQP<br>GGSLRLSCAASGSIFRINAMAWYRQAPGKQRELVAEITAGGSTNY<br>ADSVKGRFTISRDNSWNTLYLQMNSLRPEDTAVYYCNLDHYTTW<br>DRRSAYWGQGTLVTVSS |
| HER3MS00148 | 295 | EVQLVESGGGLVQPGGSLRLSCAASGFTFSSYPMSWVRQAPGKGP<br>AWVSTVSPGGITTSYADSVKGRFTISRDNSKNTLYLQMNSLRPED<br>TAVYYCLRDLGNRGQGTLVTVSSGGGGSGGGGSGGGGSGGGGS<br>GGGGSGGGGSGGGGSEVQLVESGGGLVQPGNSLRLSCAASGFTFS<br>SFGMSWVRQAPGKGLEWVSSISGSGSDTLYADSVKGRFTISRDNA<br>KTTLYLQMNSLRPEDTAVYYCTIGGSLSRSSQGTLVTVSSGGGGS<br>GGGGSGGGGSGGGGSGGGGSGGGGSEVQLVESGGGLVQ<br>PGGSLRLSCAASGSIFRINAMAWYRQAPGKQRELVAEITAGGSTN<br>YADSVKGRFTISRDNSWNTLYLQMNSLRPEDTAVYYCNLDHYTT<br>WDRRSAYWGQGTLVTVSS |
| HER3MS00149 | 296 | EVQLVESGGGLVQPGGSLRLSCAASGFTFSSYPMSWVRQAPGKGP<br>EWVSTVSPGGITTSYADSVKGRFTISRDNSKNTLYLQMNSLRPEDT<br>AVYYCLRDLGNRGQGTLVTVSSGGGGSGGGGSGGGGSGGGGSG<br>GGGSGGGGSGGGGSEVQLVESGGGLVQPGGSLRLSCAASGSIFRI<br>NAMAWYRQAPGKQRELVAEITAGGSTNYADSVKGRFTISRDNSW<br>NTLYLQMNSLRPEDTAVYYCNLDHYTTWDRRSAYWGQGTLVTV<br>SSGGGGSGGGGSGGGGSGGGGSGGGGSGGGGSGGGGSEVQLVES<br>GGGLVQPGNSLRLSCAASGFTFSSFGMSWVRQAPGKGLEWVSSIS<br>GSGSDTLYADSVKGRFTISRDNAKTTLYLQMNSLRPEDTAVYYCT<br>IGGSLSRSSQGTLVTVSS |
| HER3MS00150 | 297 | EVQLVESGGGLVQPGGSLRLSCAASGFTFSSYPMSWVRQAPGKGP<br>AWVSTVSPGGITTSYADSVKGRFTISRDNSKNTLYLQMNSLRPED<br>TAVYYCLRDLGNRGQGTLVTVSSGGGGSGGGGSGGGGSGGGGS<br>GGGGSGGGGSGGGGSEVQLVESGGGLVQPGGSLRLSCAASGSIFR<br>INAMAWYRQAPGKQRELVAEITAGGSTNYADSVKGRFTISRDNS<br>WNTLYLQMNSLRPEDTAVYYCNLDHYTTWDRRSAYWGQGTLV<br>TVSSGGGGSGGGGSGGGGSGGGGSGGGGSGGGGSGGGGSEVQL<br>VESGGGLVQPGNSLRLSCAASGFTFSSFGMSWVRQAPGKGLEWV<br>SSISGSGSDTLYADSVKGRFTISRDNAKTTLYLQMNSLRPEDTAVY<br>YCTIGGSLSRSSQGTLVTVSS |
| HER3MS00151 | 298 | DVQLVESGGGLVQPGGSLRLSCAASGSIFRINAMAWYRQAPGKQ<br>RELVAEITAGGSTNYADSVKGRFTISRDNSWNTLYLQMNSLRPED<br>TAVYYCNLDHYTTWDRRSAYWGQGTLVTVSSGGGGSGGGGSGG<br>GGSGGGGSGGGGSGGGGSEVQLVESGGGLVQPGNSLRLS<br>CAASGFTFSSFGMSWVRQAPGKGLEWVSSISGSGSDTLYADSVKG<br>RFTISRDNAKTTLYLQMNSLRPEDTAVYYCTIGGSLSRSSQGTLVT<br>VSSGGGGSGGGGSGGGGSGGGGSGGGGSGGGGSGGGGSEVQLV<br>ESGGGLVQPGGSLRLSCAASGFTFSSYPMSWVRQAPGKGPEWVS<br>TVSPGGITTSYADSVKGRFTISRDNSKNTLYLQMNSLRPEDTAVY<br>YCLRDLGNRGQGTLVTVSS |
| HER3MS00152 | 299 | DVQLVESGGGLVQPGGSLRLSCAASGSIFRINAMAWYRQAPGKQ<br>RELVAEITAGGSTNYADSVKGRFTISRDNSWNTLYLQMNSLRPED<br>TAVYYCNLDHYTTWDRRSAYWGQGTLVTVSSGGGGSGGGGSGG<br>GGSGGGGSGGGGSGGGGSEVQLVESGGGLVQPGNSLRLS<br>CAASGFTFSSFGMSWVRQAPGKGLEWVSSISGSGSDTLYADSVKG<br>RFTISRDNAKTTLYLQMNSLRPEDTAVYYCTIGGSLSRSSQGTLVT<br>VSSGGGGSGGGGSGGGGSGGGGSGGGGSGGGGSGGGGSEVQLV<br>ESGGGLVQPGGSLRLSCAASGFTFSSYPMSWVRQAPGKGPAWVS<br>TVSPGGITTSYADSVKGRFTISRDNSKNTLYLQMNSLRPEDTAVY<br>YCLRDLGNRGQGTLVTVSS |
| HER3MS00153 | 300 | DVQLVESGGGLVQPGGSLRLSCAASGSIFRINAMAWYRQAPGKQ<br>RELVAEITAGGSTNYADSVKGRFTISRDNSWNTLYLQMNSLRPED<br>TAVYYCNLDHYTTWDRRSAYWGQGTLVTVSSGGGGSGGGGSGG<br>GGSGGGGSGGGGSGGGGSEVQLVESGGGLVQPGGSLRLS<br>CAASGFTFSSYPMSWVRQAPGKGPEWVSTVSPGGITTSYADSVKG<br>RFTISRDNSKNTLYLQMNSLRPEDTAVYYCLRDLGNRGQGTLVTV<br>SSGGGGSGGGGSGGGGSGGGGSGGGGSGGGGSGGGGSEVQLVES<br>GGGLVQPGNSLRLSCAASGFTFSSFGMSWVRQAPGKGLEWVSSIS |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | GSGSDTLYADSVKGRFTISRDNAKTTLYLQMNSLRPEDTAVYYCT IGGSLSRSSQGTLVTVSS |
| HER3MS00154 | 301 | DVQLVESGGGLVQPGGSLRLSCAASGSIFRINAMAWYRQAPGKQ RELVAEITAGGSTNYADSVKGRFTISRDNSWNTLYLQMNSLRPED TAVYYCNLDHYTTWDRRSAYWGQGTLVTVSSGGGGSGGGGSGG GGSGGGGSGGGGSGGGGSGGGGSEVQLVESGGGLVQPGGSLRLS CAASGFTFSSYPMSWVRQAPGKGPAWVSTVSPGGITTSYADSVK GRFTISRDNSKNTLYLQMNSLRPEDTAVYYCLRDLGNRGQGTLVT VSSGGGGSGGGGSGGGGSGGGGSGGGGSGGGGSGGGGSEVQLV ESGGGLVQPGNSLRLSCAASGFTFSSFGMSWVRQAPGKGLEWVS SISGSGSDTLYADSVKGRFTISRDNAKTTLYLQMNSLRPEDTAVY YCTIGGSLSRSSQGTLVTVSS |
| HER3MS00155 | 302 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCLRDLGNRGQGTLVTVSSGGGGSGGGGSGGGGSGGGGSG GGGSGGGGSGGGGSEVQLVESGGGLVQPGNSLRLSCAASGFTFSS FGMSWVRQAPGKGLEWVSSISGSGSDTLYADSVKGRFTISRDNAK TTLYLQMNSLRPEDTAVYYCTIGGSLSRSSQGTLVTVSSGGGGSG GGGSGGGGSGGGGSGGGGSGGGGSEVQLVESGGGLVQP GGSLRLSCAASGTLFKINAMGWYRQAPGKRRELVALITSSDTTDY AEDVKGRFTISRDNSWNTVYLQMNSLRPEDTAVYYCHSDHYSLG VPEKRVILYGQGTLVTVSS |
| HER3MS00156 | 303 | EVQLVESGGGLVQPGGSLRLSCAASGFTFSSYPMSWVRQAPGKGP AWVSTVSPGGITTSYADSVKGRFTISRDNSKNTLYLQMNSLRPED TAVYYCLRDLGNRGQGTLVTVSSGGGGSGGGGSGGGGSGGGGS GGGGSGGGGSGGGGSEVQLVESGGGLVQPGNSLRLSCAASGFTFS SFGMSWVRQAPGKGLEWVSSISGSGSDTLYADSVKGRFTISRDNA KTTLYLQMNSLRPEDTAVYYCTIGGSLSRSSQGTLVTVSSGGGGS GGGGSGGGGSGGGGSGGGGSGGGGSEVQLVESGGGLVQ PGGSLRLSCAASGTLFKINAMGWYRQAPGKRRELVALITSSDTTD YAEDVKGRFTISRDNSWNTVYLQMNSLRPEDTAVYYCHSDHYSL GVPEKRVILYGQGTLVTVSS |
| HER3MS00157 | 304 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCLRDLGNRGQGTLVTVSSGGGGSGGGGSGGGGSGGGGSG GGGSGGGGSGGGGSEVQLVESGGGLVQPGGSLRLSCAASGTLFKI NAMGWYRQAPGKRRELVALITSSDTTDYAEDVKGRFTISRDNSW NTVYLQMNSLRPEDTAVYYCHSDHYSLGVPEKRVILYGQGTLVT VSSGGGGSGGGGSGGGGSGGGGSGGGGSGGGGSGGGGSEVQLV ESGGGLVQPGNSLRLSCAASGFTFSSFGMSWVRQAPGKGLEWVS SISGSGSDTLYADSVKGRFTISRDNAKTTLYLQMNSLRPEDTAVY YCTIGGSLSRSSQGTLVTVSS |
| HER3MS00158 | 305 | EVQLVESGGGLVQPGGSLRLSCAASGFTFSSYPMSWVRQAPGKGP AWVSTVSPGGITTSYADSVKGRFTISRDNSKNTLYLQMNSLRPED TAVYYCLRDLGNRGQGTLVTVSSGGGGSGGGGSGGGGSGGGGS GGGGSGGGGSGGGGSEVQLVESGGGLVQPGGSLRLSCAASGTLF KINAMGWYRQAPGKRRELVALITSSDTTDYAEDVKGRFTISRDNS WNTVYLQMNSLRPEDTAVYYCHSDHYSLGVPEKRVILYGQGTLV TVSSGGGGSGGGGSGGGGSGGGGSGGGGSGGGGSGGGGSEVQL VESGGGLVQPGNSLRLSCAASGFTFSSFGMSWVRQAPGKGLEWV SSISGSGSDTLYADSVKGRFTISRDNAKTTLYLQMNSLRPEDTAVY YCTIGGSLSRSSQGTLVTVSS |
| HER3MS00159 | 306 | EVQLVESGGGLVQPGGSLRLSCAASGTLFKINAMGWYRQAPGKR RELVALITSSDTTDYAEDVKGRFTISRDNSWNTVYLQMNSLRPED TAVYYCHSDHYSLGVPEKRVILYGQGTLVTVSSGGGGSGGGGSG GGGSGGGGSGGGGSGGGGSEVQLVESGGGLVQPGNSLRL SCAASGFTFSSFGMSWVRQAPGKGLEWVSSISGSGSDTLYADSVK GRFTISRDNAKTTLYLQMNSLRPEDTAVYYCTIGGSLSRSSQGTLV TVSSGGGGSGGGGSGGGGSGGGGSGGGGSGGGGSGGGGSEVQL VESGGGLVQPGGSLRLSCAASGFTFSSYPMSWVRQAPGKGPEWV STVSPGGITTSYADSVKGRFTISRDNSKNTLYLQMNSLRPEDTAVY YCLRDLGNRGQGTLVTVSS |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
| --- | --- | --- |
| HER3MS00160 | 307 | EVQLVESGGGLVQPGGSLRLSCAASGTLFKINAMGWYRQAPGKR RELVALITSSDTTDYAEDVKGRFTISRDNSWNTVYLQMNSLRPED TAVYYCHSDHYSLGVPEKRVILYGQGTLVTVSSGGGGSGGGGSG GGGSGGGGSGGGGSGGGGSGGGGSEVQLVESGGGLVQPGGSLRL SCAASGFTFSSFGMSWVRQAPGKGLEWVSSISGSGSDTLYADSVK GRFTISRDNAKTTLYLQMNSLRPEDTAVYYCTIGGSLSRSSQGTLV TVSSGGGGSGGGGSGGGGSGGGGSGGGGSGGGGSEVQL VESGGGLVQPGGSLRLSCAASGFTFSSYPMSWVRQAPGKGPAWV STVSPGGITTSYADSVKGRFTISRDNSKNTLYLQMNSLRPEDTAVY YCLRDLGNRGQGTLVTVSS |
| HER3MS00161 | 308 | EVQLVESGGGLVQPGGSLRLSCAASGTLFKINAMGWYRQAPGKR RELVALITSSDTTDYAEDVKGRFTISRDNSWNTVYLQMNSLRPED TAVYYCHSDHYSLGVPEKRVILYGQGTLVTVSSGGGGSGGGGSG GGGSGGGGSGGGGSGGGGSGGGGSEVQLVESGGGLVQPGGSLRL SCAASGFTFSSYPMSWVRQAPGKGPEWVSTVSPGGITTSYADSVK GRFTISRDNSKNTLYLQMNSLRPEDTAVYYCLRDLGNRGQGTLVT VSSGGGGSGGGGSGGGGSGGGGSGGGGSGGGGSEVQLV ESGGGLVQPGNSLRLSCAASGFTFSSFGMSWVRQAPGKGLEWVS SISGSGSDTLYADSVKGRFTISRDNAKTTLYLQMNSLRPEDTAVY YCTIGGSLSRSSQGTLVTVSS |
| HER3MS00162 | 309 | EVQLVESGGGLVQPGGSLRLSCAASGTLFKINAMGWYRQAPGKR RELVALITSSDTTDYAEDVKGRFTISRDNSWNTVYLQMNSLRPED TAVYYCHSDHYSLGVPEKRVILYGQGTLVTVSSGGGGSGGGGSG GGGSGGGGSGGGGSGGGGSGGGGSEVQLVESGGGLVQPGGSLRL SCAASGFTFSSYPMSWVRQAPGKGPAWVSTVSPGGITTSYADSVK GRFTISRDNSKNTLYLQMNSLRPEDTAVYYCLRDLGNRGQGTLVT VSSGGGGSGGGGSGGGGSGGGGSGGGGSGGGGSEVQLV ESGGGLVQPGNSLRLSCAASGFTFSSFGMSWVRQAPGKGLEWVS SISGSGSDTLYADSVKGRFTISRDNAKTTLYLQMNSLRPEDTAVY YCTIGGSLSRSSQGTLVTVSS |
| HER3MS00199 | 310 | EVQLVESGGGLVQPGGSLRLSCAASGTLFKINAMGWYRQAPGKR RELVALITSSDTTDYAEDVKGRFTISRDNSWNTVYLQMNSLRPED TAVYYCHSDHYSLGVPEKRVILYGQGTLVTVSSGGGGSGGGGSEV QLVESGGGLVQPGNSLRLSCAASGFTFSSFGMSWVRQAPGKGLE WVSSISGSGSDTLYADSVKGRFTISRDNAKTTLYLQMNSLRPEDT AVYYCTIGGSLSRSSQGTLVTVSSGGGGSGGGSEVQLVESGGGLV QPGGSLRLSCAASGRTYYLNAMGWFRQAPGKEREFVAAIDWSEG NKDYADSVKGRFTISRDASKNTVYLQMNSLRPEDTAVYYCAADT PPWGPLIYIESYDSWGQGTLVTVSS |
| HER3MS00200 | 311 | EVQLVESGGGLVQPGGSLRLSCAASGTLFKINAMGWYRQAPGKR RELVALITSSDTTDYAEDVKGRFTISRDNSWNTVYLQMNSLRPED TAVYYCHSDHYSLGVPEKRVILYGQGTLVTVSSGGGGSGGGSEV QLVESGGGLVQPGGSLRLSCAASGRTYYLNAMGWFRQAPGKERE FVAAIDWSEGNKDYADSVKGRFTISRDASKNTVYLQMNSLRPED TAVYYCAADTPPWGPLIYIESYDSWGQGTLVTVSSGGGGSGGGSE VQLVESGGGLVQPGNSLRLSCAASGFTFSSFGMSWVRQAPGKGL EWVSSISGSGSDTLYADSVKGRFTISRDNAKTTLYLQMNSLRPEDT AVYYCTIGGSLSRSSQGTLVTVSS |
| HER3MS00201 | 312 | EVQLVESGGGLVQPGGSLRLSCAASGRTYYLNAMGWFRQAPGKE REFVAAIDWSEGNKDYADSVKGRFTISRDASKNTVYLQMNSLRPE DTAVYYCAADTPPWGPLIYIESYDSWGQGTLVTVSSGGGGSGGG SEVQLVESGGGLVQPGNSLRLSCAASGFTFSSFGMSWVRQAPGKG LEWVSSISGSGSDTLYADSVKGRFTISRDNAKTTLYLQMNSLRPED TAVYYCTIGGSLSRSSQGTLVTVSSGGGGSGGGSEVQLVESGGGL VQPGGSLRLSCAASGTLFKINAMGWYRQAPGKRRELVALITSSDT TDYAEDVKGRFTISRDNSWNTVYLQMNSLRPEDTAVYYCHSDHY SLGVPEKRVILYGQGTLVTVSS |
| HER3MS00202 | 313 | EVQLVESGGGLVQPGGSLRLSCAASGRTYYLNAMGWFRQAPGKE REFVAAIDWSEGNKDYADSVKGRFTISRDASKNTVYLQMNSLRPE DTAVYYCAADTPPWGPLIYIESYDSWGQGTLVTVSSGGGGSGGG SEVQLVESGGGLVQPGGSLRLSCAASGTLFKINAMGWYRQAPGK RRELVALITSSDTTDYAEDVKGRFTISRDNSWNTVYLQMNSLRPE DTAVYYCHSDHYSLGVPEKRVILYGQGTLVTVSSGGGGSGGGSE |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | VQLVESGGGLVQPGNSLRLSCAASGFTFSSFGMSWVRQAPGKGL EWVSSISGSGSDTLYADSVKGRFTISRDNAKTTLYLQMNSLRPEDT AVYYCTIGGSLSRSSQGTLVTVSS |
| HER3MS00207 | 314 | EVQLVESGGGLVQPGGSLRLSCAASGTLFKINAMGWYRQAPGKR RELVALITSSDTTDYAEDVKGRFTISRDNSWNTVYLQMNSLRPED TAVYYCHSDHYSLGVPEKRVILYGQGTLVTVSSGGGGSGGGSEV QLVESGGGLVQPGNSLRLSCAASGFTFSSFGMSWVRQAPGKGLE WVSSISGSGSDTLYADSVKGRFTISRDNAKTTLYLQMNSLRPEDT AVYYCTIGGSLSRSSQGTLVTVSSGGGGSGGGSEVQLVESGGGLV QPGGSLRLSCAASGSIGGLNAMAWYRQAPGKERELVAGIFGVGST RYADSVKGRFTISRDNSKNTVYLQMNSLRPEDTAVYYCRMSSVT RGSSDYWGQGTLVTVSS |
| HER3MS00208 | 315 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCLRDLGNRGQGTLVTVSSGGGGSGGGSEVQLVESGGGLVQ PGNSLRLSCAASGFTFSSFGMSWVRQAPGKGLEWVSSISGSGSDT LYADSVKGRFTISRDNAKTTLYLQMNSLRPEDTAVYYCTIGGSLS RSSQGTLVTVSSGGGGSGGGSEVQLVESGGGLVQPGGSLRLSCAA SGTLFKINAMGWYRQAPGKRRELVALITSSDTTDYAEDVKGRFTI SRDNSWNTVYLQMNSLRPEDTAVYYCHSDHYSLGVPEKRVILYG QGTLVTVSS |
| HER3MS00209 | 316 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGSEVQLVE SGGGLVQPGNSLRLSCAASGFTFSSFGMSWVRQAPGKGLEWVSSI SGSGSDTLYADSVKGRFTISRDNAKTTLYLQMNSLRPEDTAVYYC TIGGSLSRSSQGTLVTVSS |
| HER3MS00210 | 317 | EVQLVESGGGLVQPGGSLRLSCAASGRTYYLNAMGWFRQAPGKE REFVAAIDWSEGNKDYADSVKGRFTISRDNSKNTVYLQMNSLRPE DTAVYYCAADTPPWGPLIYIESYDSWGQGTLVTVSSGGGGSGGG SEVQLVESGGGLVQPGNSLRLSCAASGFTFSSFGMSWVRQAPGKG LEWVSSISGSGSDTLYADSVKGRFTISRDNAKTTLYLQMNSLRPED TAVYYCTIGGSLSRSSQGTLVTVSSGGGGSGGGSEVQLVESGGGL VQPGGSLRLSCAASGTLFKINAMGWYRQAPGKRRELVALITSSDT TDYAEDVKGRFTISRDNSWNTVYLQMNSLRPEDTAVYYCHSDHY SLGVPEKRVILYGQGTLVTVSS |
| HER3MS00211 | 318 | EVQLVESGGGLVQPGGSLRLSCAASGTLFKINAMGWYRQAPGKR RELVALITSSDTTDYADSVKGRFTISRDNSWNTVYLQMNSLRPED TAVYYCHSDHYSLGVPEKRVILYGQGTLVTVSSAAAEQKLISEED LNGAAHHHHHH |
| HER3MS00212 | 319 | DVQLVESGGGLVQPGGSLRLSCAASGSIGGLNAMAWYRQAPGKE RELVAGIFGVGSTRYADSVKGRFTISRDNSKNTVYLQMNSLRPED TAVYYCRMSSVTRGSSDYWGQGTLVTVSSGGGGSGGGSEVQLVE SGGGLVQPGNSLRLSCAASGFTFSSFGMSWVRQAPGKGLEWVSSI SGSGSDTLYADSVKGRFTISRDNAKTTLYLQMNSLRPEDTAVYYC TIGGSLSRSSQGTLVTVSSGGGGSGGGSEVQLVESGGGLVQPGGS LRLSCAASGTLFKINAMGWYRQAPGKRRELVALITSSDTTDYADS VKGRFTISRDNSWNTVYLQMNSLRPEDTAVYYCHSDHYSLGVPE KRVILYGQGTLVTVSS |
| HER3MS00213 | 320 | EVQLVESGGGLVQPGGSLRLSCAASGFTFSSYPMSWVRQAPGKGP EWVSTVSPGGITTSYADSVKGRFTISRDNSKNTLYLQMNSLRPEDT AVYYCLRDLGNRGQGTLVTVSSGGGGSGGGSEVQLVESGGGLVQ PGNSLRLSCAASGFTFSSFGMSWVRQAPGKGLEWVSSISGSGSDT LYADSVKGRFTISRDNAKTTLYLQMNSLRPEDTAVYYCTIGGSLS RSSQGTLVTVSSGGGGSGGGSEVQLVESGGGLVQPGGSLRLSCAA SGTLFKINAMGWYRQAPGKRRELVALITSSDTTDYADSVKGRFTI SRDNSWNTVYLQMNSLRPEDTAVYYCHSDHYSLGVPEKRVILYG QGTLVTVSS |
| HER3MS00214 | 321 | EVQLVESGGGLVQPGGSLRLSCAASGRTYYLNAMGWFRQAPGKE REFVAAIDWSEGNKDYADSVKGRFTISRDNSKNTVYLQMNSLRPE DTAVYYCAADTPPWGPLIYIESYDSWGQGTLVTVSSGGGGSGGG SEVQLVESGGGLVQPGNSLRLSCAASGFTFSSFGMSWVRQAPGKG |

TABLE A-2-continued

Preferred polypeptide or compound sequences
(also referred herein as a sequence with a particular
name or SEQ ID NO: X, wherein X is a number referring
to the relevant amino acid sequence):

| Name | SEQ ID NO: X, wherein X = | Amino acid sequence |
|---|---|---|
| | | LEWVSSISGSGSDTLYADSVKGRFTISRDNAKTTLYLQMNSLRPED TAVYYCTIGGSLSRSSQGTLVTVSSGGGGSGGGSEVQLVESGGGL VQPGGSLRLSCAASGTLFKINAMGWYRQAPGKRRELVALITSSDT TDYADSVKGRFTISRDNSWNTVYLQMNSLRPEDTAVYYCHSDHY SLGVPEKRVILYGQGTLVTVSS |
| HER3MS00215 | 322 | EVQLVESGGGLVQPGGSLRLSCAASGTLFKINAMGWYRQAPGKR RELVALITSSDTTDYADSVKGRFTISRDNSWNTVYLQMNSLRPED TAVYYCHSDHYSLGVPEKRVILYGQGTLVTVSSGGGGSGGGSEV QLVESGGGLVQPGNSLRLSCAASGFTFSSFGMSWVRQAPGKGLE WVSSISGSGSDTLYADSVKGRFTISRDNAKTTLYLQMNSLRPEDT AVYYCTIGGSLSRSSQGTLVTVSSGGGGSGGGSEVQLVESGGGLV QPGGSLRLSCAASGSIGGLNAMAWYRQAPGKERELVAGIFGVGST RYADSVKGRFTISRDNSKNTVYLQMNSLRPEDTAVYYCRMSSVT RGSSDYWGQGTLVTVSS |
| HER3MS004C07 | 323 | EVQLVESGGGLVQAGGSLRLSCAASGFTFSSYPMSWVRQAPGKG PAWVSTVSPGGITTSYADSVKGRFTISRDNAKNTLYLQMNSLKPE DTAVYYCLRDLNNRGQGTQVTVSSAAAEQKLISEEDLNGAAHHH HHH |
| HER3MS017B05 | 324 | EVQLVESGGGLVQPGGSLRLSCAASGSIGGLNAMAWYRQAPGKE RELVAGIFGVGSTRYADSVKGRFTISRDIAKNTVFLQMNSLNSEDT AVYYCRMSSVTRGSSDYWGQGTQVTVSSAAAEQKLISEEDLNGA AHHHHHH |
| HER3MS018G11 | 325 | EVQLVESGGGLVQPGGSLRLSCAASGTLFKINAMGWYRQAPGKR RELVALITSSDTTDYAESVEGRFTISRDNTWNAVYLQMNSLKPED TAVYYCHSDHYSMGVPEKRVIMYGQGTQVTVSSAAAEQKLISEE DLNGAAHHHHHH |
| HER3MS021F06 | 326 | EVQLVESGGGLVQAGGSLRLSCAASGRTYYLNAMGWFRQGPGK DREFVAAIDWSDGNKDYADSVKGRFTISRDNAKNTVYLQMNSLK PEDTAVYYCAADTPPWGPMIYIESYDSWGQGTQVTVSSAAAEQK LISEEDLNGAAHHHHHH |
| HER3MS034C07 | 327 | EVQLVESGGGLVQPGGSLGLSCVASGSIFRINAMAWYRQAPGKQ RELVAEITAGGSTNYADSVKGRFTISVDNAWNTLYLQMNSLKVE DTAVYYCNLDHYTTWDRRSAYWGQGTQVTVSSAAAEQKLISEE DLNGAAHHHHHH |

It will be clear to the skilled person that the Nanobodies that are mentioned herein as "preferred" (or "more preferred", "even more preferred", etc.) are also preferred (or more preferred, or even more preferred, etc.) for use in the polypeptides described herein. Thus, polypeptides that comprise or essentially consist of one or more "preferred" Nanobodies of the invention will generally be preferred, and polypeptides that comprise or essentially consist of one or more "more preferred" Nanobodies of the invention will generally be more preferred, etc.

Generally, proteins or polypeptides that comprise or essentially consist of a single Nanobody (such as a single Nanobody of the invention) will be referred to herein as "monovalent" proteins or polypeptides or as "monovalent constructs". Proteins and polypeptides that comprise or essentially consist of two or more Nanobodies (such as at least two Nanobodies of the invention or at least one Nanobody of the invention and at least one other Nanobody) will be referred to herein as "multivalent" proteins or polypeptides or as "multivalent constructs", and these may provide certain advantages compared to the corresponding monovalent Nanobodies of the invention. Some non-limiting examples of such multivalent constructs will become clear from the further description herein.

According to one specific, but non-limiting aspect, a polypeptide of the invention comprises or essentially consists of at least two Nanobodies of the invention, such as two or three Nanobodies of the invention. As further described herein, such multivalent constructs can provide certain advantages compared to a protein or polypeptide comprising or essentially consisting of a single Nanobody of the invention, such as a much improved avidity for HER3. Such multivalent constructs will be clear to the skilled person based on the disclosure herein; some preferred, but non-limiting examples of such multivalent Nanobody constructs are the constructs of SEQ ID NO's: 147 to 327, more preferably HER3MS00135 (SEQ ID NO:282), HER3MS00212 (SEQ ID NO:319) or HER3MS00215 (SEQ ID NO:322). According to another specific, but non-limiting aspect, a polypeptide of the invention comprises or essentially consists of at least one Nanobody of the invention and at least one other binding unit (i.e. directed against another epitope, antigen, target, protein or polypeptide), which is preferably also a Nanobody. Such proteins or polypeptides are also referred to herein as "multispecific" proteins or polypeptides or as 'multispecific constructs", and these may provide certain advantages compared to the corresponding monovalent Nanobodies of the invention (as will become clear from the further discussion herein of some preferred, but, non-limiting multispecific constructs). Such multispecific constructs will be clear to the skilled person based on the disclosure herein; some preferred, but non-limiting examples of such multispecific Nanobody constructs are the constructs of SEQ ID NO's: 147 to 327, more preferably HER3MS00135 (SEQ ID NO:282), HER3MS00212 (SEQ ID NO:319) or HER3MS00215 (SEQ ID NO:322).

According to yet another specific, but non-limiting aspect, a polypeptide of the invention comprises or essentially consists of at least one Nanobody of the invention, optionally one or more further Nanobodies, and at least one other amino acid sequence (such as a protein or polypeptide) that confers at least one desired property to the Nanobody of the invention and/or to the resulting fusion protein. Again, such fusion proteins may provide certain advantages compared to the corresponding monovalent Nanobodies of the invention. Some non-limiting examples of such amino acid sequences and of such fusion constructs will become clear from the further description herein.

It is also possible to combine two or more of the above aspects, for example to provide a trivalent bispecific construct comprising two Nanobodies of the invention and one other Nanobody, and optionally one or more other amino acid sequences. Further non-limiting examples of such constructs, as well as some constructs that are particularly preferred within the context of the present invention, will become clear from the further description herein.

In the above constructs, the one or more Nanobodies and/or other amino acid sequences may be directly linked to each other and/or suitably linked to each other via one or more linker sequences. Some suitable but non-limiting examples of such linkers will become clear from the further description herein.

In one specific aspect of the invention, a Nanobody of the invention or a compound, construct or polypeptide of the invention comprising at least one Nanobody of the invention may have an increased half-life, compared to the corresponding amino acid sequence of the invention. Some preferred, but non-limiting examples of such Nanobodies, compounds and polypeptides will become clear to the skilled person based on the further disclosure herein, and for example comprise Nanobodies sequences or polypeptides of the invention that have been chemically modified to increase the half-life thereof (for example, by means of pegylation); amino acid sequences of the invention that comprise at least one additional binding site for binding to a serum protein (such as serum albumin, see for example EP 0 368 684 B1, page 4); or polypeptides of the invention that comprise at least one Nanobody of the invention that is linked to at least one moiety (and in particular at least one amino acid sequence) that increases the half-life of the Nanobody of the invention. Examples of polypeptides of the invention that comprise such half-life extending moieties or amino acid sequences will become clear to the skilled person based on the further disclosure herein; and for example include, without limitation, polypeptides in which the one or more Nanobodies of the invention are suitable linked to one or more serum proteins or fragments thereof (such as serum albumin or suitable fragments thereof) or to one or more binding units that can bind to serum proteins (such as, for example, Nanobodies or (single) domain antibodies that can bind to serum proteins such as serum albumin, serum immunoglobulins such as IgG, or transferrine); polypeptides in which a Nanobody of the invention is linked to an Fc portion (such as a human Fc) or a suitable part or fragment thereof; or polypeptides in which the one or more Nanobodies of the invention are suitable linked to one or more small proteins or peptides that can bind to serum proteins.

Again, as will be clear to the skilled person, such Nanobodies, compounds, constructs or polypeptides may contain one or more additional groups, residues, moieties or binding units, such as one or more further amino acid sequences and in particular one or more additional Nanobodies (i.e. not directed against HER3), so as to provide a tri- of multispecific Nanobody construct.

Generally, the Nanobodies of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the Nanobodies, compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such Nanobodies, compound, constructs or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days). Such half-life extended constructs will be clear to the skilled person based on the disclosure herein; some preferred, but non-limiting examples of such multispecific Nanobody constructs are the constructs of SEQ ID NO's: 147 to 327, more preferably HER3MS00135 (SEQ ID NO:282), HER3MS00212 (SEQ ID NO:319) or HER3MS00215 (SEQ ID NO:322).

In particular, polypeptides comprising one or more Nanobodies of the invention are preferably such that they:

bind to HER3 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to HER3 with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to HER3 with a $k_{off}$ rate between $1$ $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a polypeptide that contains only one amino acid sequence of the invention is preferably such that it will bind to HER3 with an affinity less than 500 nM, preferably less than 200 nM, more preferably less than 10 nM, such as less than 1 nM. In this respect, it will be clear to the skilled person that a polypeptide that contains two or more Nanobodies of the invention may bind to HER3 with an increased avidity, compared to a polypeptide that contains only one amino acid sequence of the invention.

Some preferred $IC_{50}$ values for binding of the amino acid sequences or polypeptides of the invention to HER3 will become clear from the further description and examples herein.

Other polypeptides according to this preferred aspect of the invention may for example be chosen from the group consisting of amino acid sequences that have more than 80%, preferably more than 90%, more preferably more than 95%, such as 99% or more "sequence identity" (as defined herein) with one or more of the amino acid sequences of SEQ ID NO's: 147 to 327, more preferably HER3MS00135 (SEQ ID NO:282), HER3MS00212 (SEQ ID NO:319) or HER3MS00215 (SEQ ID NO:322) (see Table A-2), in which the Nanobodies comprised within said amino acid sequences are preferably as further defined herein.

Another aspect of this invention relates to a nucleic acid that encodes an amino acid sequence of the invention (such as an ISV or Nanobody of the invention) or a polypeptide of the invention comprising the same. Again, as generally described herein for the nucleic acids of the invention, such a nucleic acid may be in the form of a genetic construct, as defined herein.

Other nucleic acids according to a preferred aspect of the invention may for example be chosen from the group consisting of nucleic acid sequences that have more than 80%, preferably more than 90%, more preferably more than 95%, such as 99% or more "sequence identity" (as defined herein) with one or more of the nucleic acid sequences of SEQ ID NO's: 27 to 41 (see FIG. 1).

In another aspect, the invention relates to host or host cell that expresses or that is capable of expressing an amino acid sequence (such as a Nanobody) of the invention and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid sequence of the invention, at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acid sequences, compounds, constructs, polypeptides, nucleic acids, host cells, products and compositions described herein. Some preferred but non-limiting examples of such methods will become clear from the further description herein.

The invention further relates to applications and uses of the amino acid sequences, compounds, constructs, polypeptides, nucleic acids, host cells, products and compositions described herein, as well as to methods for the prevention and/or treatment for diseases and disorders associated with HER3. Some preferred but non-limiting applications and uses will become clear from the further description herein.

Other aspects, embodiments, advantages and applications of the invention will also become clear from the further description herein below.

Generally, it should be noted that the term Nanobody as used herein in its broadest sense is not limited to a specific biological source or to a specific method of preparation. For example, as will be discussed in more detail below, the Nanobodies of the invention can generally be obtained by any of the techniques (1) to (8) mentioned on pages 61 and 62 of WO 08/020,079, or any other suitable technique known per se. One preferred class of Nanobodies corresponds to the $V_{HH}$ domains of naturally occurring heavy chain antibodies directed against HER3. As further described herein, such $V_{HH}$ sequences can generally be generated or obtained by suitably immunizing a species of Camelid with HER3 (i.e. so as to raise an immune response and/or heavy chain antibodies directed against HER3), by obtaining a suitable biological sample from said Camelid (such as a blood sample, serum sample or sample of B-cells), and by generating $V_{HH}$ sequences directed against HER3, starting from said sample, using any suitable technique known per se. Such techniques will be clear to the skilled person and/or are further described herein.

Alternatively, such naturally occurring $V_{HH}$ domains against HER3, can be obtained from naïve libraries of Camelid $V_{HH}$ sequences, for example by screening such a library using HER3, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

Thus, in another aspect, the invention relates to a method for generating Nanobodies, that are directed against HER3. In one aspect, said method at least comprises the steps of:
a) providing a set, collection or library of Nanobody sequences; and
b) screening said set, collection or library of Nanobody sequences for Nanobody sequences that can bind to and/or have affinity for HER3;
and
c) isolating the Nanobody or Nanobodies that can bind to and/or have affinity for HER3.

In such a method, the set, collection or library of Nanobody sequences may be a naïve set, collection or library of Nanobody sequences; a synthetic or semi-synthetic set, collection or library of Nanobody sequences; and/or a set, collection or library of Nanobody sequences that have been subjected to affinity maturation.

In a preferred aspect of this method, the set, collection or library of Nanobody sequences may be an immune set, collection or library of Nanobody sequences, and in particular an immune set, collection or library of $V_{HH}$ sequences, that have been derived from a species of Camelid that has been suitably immunized with HER3 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of Nanobody or $V_{HH}$ sequences may be displayed on a phage, phagemid, ribosome or suitable micro-organism (such as yeast), such as to facilitate screening. Suitable methods, techniques and host organisms for displaying and screening (a set, collection or library of) Nanobody sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating Nanobody sequences comprises at least the steps of:

a) providing a collection or sample of cells derived from a species of Camelid that express immunoglobulin sequences;
b) screening said collection or sample of cells for (i) cells that express an immunoglobulin sequence that can bind to and/or have affinity for HER3; and (ii) cells that express heavy chain antibodies, in which substeps (i) and (ii) can be performed essentially as a single screening step or in any suitable order as two separate screening steps, so as to provide at least one cell that expresses a heavy chain antibody that can bind to and/or has affinity for HER3; and
c) either (i) isolating from said cell the $V_{HH}$ sequence present in said heavy chain antibody; or (ii) isolating from said cell a nucleic acid sequence that encodes the $V_{HH}$ sequence present in said heavy chain antibody, followed by expressing said $V_{HH}$ domain.

In the method according to this aspect, the collection or sample of cells may for example be a collection or sample of B-cells. Also, in this method, the sample of cells may be derived from a Camelid that has been suitably immunized with HER3 or a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820. Particular reference is made to the so-called "Nanoclone®" technique described in International application WO 06/079372 by Ablynx N.V.

In another aspect, the method for generating an amino acid sequence directed against HER3 may comprise at least the steps of:

a) providing a set, collection or library of nucleic acid sequences encoding heavy chain antibodies or Nanobody sequences;
b) screening said set, collection or library of nucleic acid sequences for nucleic acid sequences that encode a heavy chain antibody or a Nanobody sequence that can bind to and/or has affinity for HER3; and
c) isolating said nucleic acid sequence, followed by expressing the $V_{HH}$ sequence present in said heavy chain antibody or by expressing said Nanobody sequence, respectively.

In such a method, the set, collection or library of nucleic acid sequences encoding heavy chain antibodies or Nanobody sequences may for example be a set, collection or library of nucleic acid sequences encoding a naïve set, collection or library of heavy chain antibodies or $V_{HH}$ sequences; a set, collection or library of nucleic acid sequences encoding a synthetic or semi-synthetic set, collection or library of Nanobody sequences; and/or a set, collection or library of nucleic acid sequences encoding a set, collection or library of Nanobody sequences that have been subjected to affinity maturation.

In a preferred aspect of this method, the set, collection or library of nucleic acid sequences may be an immune set, collection or library of nucleic acid sequences encoding heavy chain antibodies or $V_{HH}$ sequences derived from a Camelid that has been suitably immunized with HER3 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to WO03054016 and to the review by Hoogenboom in Nature Biotechnology, 23, 9, 1105-1116 (2005).

As will be clear to the skilled person, the screening step of the methods described herein can also be performed as a selection step. Accordingly the term "screening" as used in the present description can comprise selection, screening or any suitable combination of selection and/or screening techniques. Also, when a set, collection or library of sequences is used, it may contain any suitable number of sequences, such as 1, 2, 3 or about 5, 10, 50, 100, 500, 1000, 5000, $10^4$, $10^5$, $10^6$, $10^7$, $10^8$ or more sequences.

Also, one or more or all of the sequences in the above set, collection or library of amino acid sequences may be obtained or defined by rational, or semi-empirical approaches such as computer modelling techniques or biostatics or datamining techniques.

Furthermore, such a set, collection or library can comprise one, two or more sequences that are variants from one another (e.g. with designed point mutations or with randomized positions), compromise multiple sequences derived from a diverse set of naturally diversified sequences (e.g. an immune library), or any other source of diverse sequences (as described for example in Hoogenboom et al, Nat Biotechnol 23:1105, 2005 and Binz et al, Nat Biotechnol 2005, 23:1247). Such set, collection or library of sequences can be displayed on the surface of a phage particle, a ribosome, a bacterium, a yeast cell, a mammalian cell, and linked to the nucleotide sequence encoding the amino acid sequence within these carriers. This makes such set, collection or library amenable to selection procedures to isolate the desired amino acid sequences of the invention. More generally, when a sequence is displayed on a suitable host or host cell, it is also possible (and customary) to first isolate from said host or host cell a nucleotide sequence that encodes the desired sequence, and then to obtain the desired sequence by suitably expressing said nucleotide sequence in a suitable host organism. Again, this can be performed in any suitable manner known per se, as will be clear to the skilled person.

The invention also relates to the $V_{HH}$ sequences or Nanobody sequences that are obtained by the above methods, or alternatively by a method that comprises the one of the above methods and in addition at least the steps of determining the nucleotide sequence or amino acid sequence of said $V_{HH}$ sequence or Nanobody sequence; and of expressing or synthesizing said $V_{HH}$ sequence or Nanobody sequence in a manner known per se, such as by expression in a suitable host cell or host organism or by chemical synthesis.

As mentioned herein, a particularly preferred class of Nanobodies of the invention comprises Nanobodies with an amino acid sequence that corresponds to the amino acid sequence of a naturally occurring $V_{HH}$ domain, but that has been e.g. "humanized" or otherwise sequence optimized in view of better production yields or better stability, i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above), as further described on, and using the techniques mentioned on, page 63 of WO 08/020,079. Another particularly preferred class of Nanobodies of the invention comprises Nanobodies with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody, as further described on, and using the techniques mentioned on, page 63 of WO 08/020,079.

Other suitable methods and techniques for obtaining the Nanobodies of the invention and/or nucleic acids encoding the same, starting from naturally occurring $V_H$ sequences or preferably $V_{HH}$ sequences, will be clear from the skilled person, and may for example include the techniques that are mentioned on page 64 of WO 08/00279As mentioned herein, Nanobodies may in particular be characterized by the presence of one or more "Hallmark residues" (as described herein) in one or more of the framework sequences.

The invention in its broadest sense also comprises derivatives of the Nanobodies of the invention. Such derivatives can generally be obtained by modification, and in particular by chemical and/or biological (e.g enzymatical) modification, of the Nanobodies of the invention and/or of one or more of the amino acid residues that form the Nanobodies of the invention.

Examples of such modifications, as well as examples of amino acid residues within the Nanobody sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the Nanobody of the invention, and in particular of one or more functional groups, residues or moieties that confer one or more desired properties or functionalities to the Nanobody of the invention. Example of such functional groups will be clear to the skilled person.

For example, such modification may comprise the introduction (e.g. by covalent binding or in any other suitable manner) of one or more functional groups that increase the half-life, the solubility and/or the absorption of the Nanobody of the invention, that reduce the immunogenicity and/or the toxicity of the Nanobody of the invention, that eliminate or attenuate any undesirable side effects of the Nanobody of the invention, and/or that confer other advantageous properties to and/or reduce the undesired properties of the Nanobodies and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a Nanobody of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as poly(ethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a Nanobody of the invention, a Nanobody of the invention may be modified so as to suitably introduce one or more cysteine residues for attachment of PEG, or an amino acid sequence comprising one or more cysteine residues for attachment of PEG may be fused to the N- and/or C-terminus of a Nanobody of the invention, all using techniques of protein engineering known per se to the skilled person.

Preferably, for the Nanobodies and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the Nanobody or polypeptide of the invention.

Yet another modification may comprise the introduction of one or more detectable labels or other signal-generating groups or moieties, depending on the intended use of the labelled Nanobody. Suitable labels and techniques for attaching, using and detecting them will be clear to the skilled person, and for example include, but are not limited to, the fluorescent labels, phosphorescent labels, chemiluminescent labels, bioluminescent labels, radio-isotopes, metals, metal chelates, metallic cations, chromophores and enzymes, such as those mentioned on page 109 of WO 08/020,079. Other suitable labels will be clear to the skilled person, and for example include moieties that can be detected using NMR or ESR spectroscopy.

Such labelled Nanobodies and polypeptides of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethyl-enetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair. Such a functional group may be used to link the Nanobody of the invention to another protein, polypeptide or chemical compound that is bound to the other half of the binding pair, i.e. through formation of the binding pair. For example, a Nanobody of the invention may be conjugated to biotin, and linked to another protein, polypeptide, compound or carrier conjugated to avidin or streptavidin. For example, such a conjugated Nanobody may be used as a reporter, for example in a diagnostic system where a detectable signal-producing agent is conjugated to avidin or streptavidin. Such binding pairs may for example also be used to bind the Nanobody of the invention to a carrier, including carriers suitable for pharmaceutical purposes. One non-limiting example are the liposomal formulations described by Cao and Suresh, Journal of Drug Targetting, 8, 4, 257 (2000). Such binding pairs may also be used to link a therapeutically active agent to the Nanobody of the invention.

For some applications, in particular for those applications in which it is intended to kill a cell that expresses the target against which the Nanobodies of the invention are directed (e.g. in the treatment of cancer), or to reduce or slow the growth and/or proliferation such a cell, the Nanobodies of the invention may also be linked to a toxin or to a toxic residue or moiety. Examples of toxic moieties, compounds or residues which can be linked to a Nanobody of the invention to provide—for example—a cytotoxic compound will be clear to the skilled person and can for example be found in the prior art cited above and/or in the further description herein. One example is the so-called ADEPT™ technology described in WO 03/055527.

Other potential chemical and enzymatical modifications will be clear to the skilled person. Such modifications may also be introduced for research purposes (e.g. to study function-activity relationships). Reference is for example made to Lundblad and Bradshaw, Biotechnol. Appl. Biochem., 26, 143-151 (1997).

Preferably, the derivatives are such that they bind to HER3 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

As mentioned above, the invention also relates to proteins or polypeptides that essentially consist of or comprise at least one Nanobody of the invention. By "essentially consist of" is meant that the amino acid sequence of the polypeptide of the invention either is exactly the same as the amino acid sequence of a Nanobody of the invention or corresponds to the amino acid sequence of a Nanobody of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the Nanobody.

Said amino acid residues may or may not change, alter or otherwise influence the (biological) properties of the Nanobody and may or may not add further functionality to the Nanobody. For example, such amino acid residues:

can comprise an N-terminal Met residue, for example as result of expression in a heterologous host cell or host organism.

may form a signal sequence or leader sequence that directs secretion of the Nanobody from a host cell upon synthesis. Suitable secretory leader peptides will be clear to the skilled person, and may be as further described herein. Usually, such a leader sequence will be linked to the N-terminus of the Nanobody, although the invention in its broadest sense is not limited thereto;

may form a sequence or signal that allows the Nanobody to be directed towards and/or to penetrate or enter into specific organs, tissues, cells, or parts or compartments of cells, and/or that allows the Nanobody to penetrate or cross a biological barrier such as a cell membrane, a cell layer such as a layer of epithelial cells, a tumor including solid tumors, or the blood-brain-barrier. Examples of such amino acid sequences will be clear to the skilled person and include those mentioned in paragraph c) on page 112 of WO 08/020,079.

may form a "tag", for example an amino acid sequence or residue that allows or facilitates the purification of the Nanobody, for example using affinity techniques directed against said sequence or residue. Thereafter, said sequence or residue may be removed (e.g. by chemical or enzymatical cleavage) to provide the Nanobody sequence (for this purpose, the tag may optionally be linked to the Nanobody sequence via a cleavable linker sequence or contain a cleavable motif). Some preferred, but non-limiting examples of such residues are multiple histidine residues, glutatione residues and a myc-tag (see for example SEQ ID NO:31 of WO 06/12282).

may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the Nanobodies of the invention.

According to another aspect, a polypeptide of the invention comprises a Nanobody of the invention, which is fused at its amino terminal end, at its carboxy terminal end, or both at its amino terminal end and at its carboxy terminal end to at least one further amino acid sequence, i.e. so as to provide a fusion protein comprising said Nanobody of the invention and the one or more further amino acid sequences. Such a fusion will also be referred to herein as a "Nanobody fusion".

The one or more further amino acid sequence may be any suitable and/or desired amino acid sequences. The further amino acid sequences may or may not change, alter or otherwise influence the (biological) properties of the Nanobody, and may or may not add further functionality to the Nanobody or the polypeptide of the invention. Preferably, the further amino acid sequence is such that it confers one or more desired properties or functionalities to the Nanobody or the polypeptide of the invention.

For example, the further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the Nanobody of the invention is directed, or a different protein, polypeptide, antigen, antigenic determinant or epitope).

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005).

For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the Nanobody of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

In particular, it has been described in the art that linking fragments of immunoglobulins (such as $V_H$ domains) to serum albumin or to fragments thereof can be used to increase the half-life. Reference is for made to WO 00/27435 and WO 01/077137. According to the invention, the Nanobody of the invention is preferably either directly linked to serum albumin (or to a suitable fragment thereof) or via a suitable linker, and in particular via a suitable peptide linked so that the polypeptide of the invention can be expressed as a genetic fusion (protein). According to one specific aspect, the Nanobody of the invention may be linked to a fragment of serum albumin that at least comprises the domain III of serum albumin or part thereof. Reference is for example made to WO 07/112,940 of Ablynx N.V.

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the Nanobodies described below, as well as the small peptides and binding proteins described in WO 91/01743, WO 01/45746 and WO 02/076489 and the dAb's described in WO 03/002609 and WO 04/003019. Reference is also made to Harmsen et al., Vaccine, 23 (41); 4926-42, 2005, as well as to EP 0 368 684, as well as to WO 08/028,977, WO 08/043,821, WO 08/043, 822, WO 2008/068280 and WO 2009/127691).

Such amino acid sequences may in particular be directed against serum albumin (and more in particular human serum albumin) and/or against IgG (and more in particular human IgG). For example, such amino acid sequences may be amino acid sequences that are directed against (human) serum albumin and amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again for example WO 06/0122787); amino acid sequences that have or can provide an increased half-life (see for example WO 08/028,977 by Ablynx N.V.); amino acid sequences against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*), reference is again made to WO 08/028,977; amino acid sequences that can bind to serum albumin in a pH independent manner (see for example WO 08/043,821 by Ablynx N.V. entitled "Amino acid sequences that bind to serum proteins in a manner that is essentially independent of the pH, compounds comprising the same, and uses thereof") and/or amino acid sequences that are conditional binders (see for example WO 08/043,822 by Ablynx N.V. entitled "Amino acid sequences that bind to a desired molecule in a conditional manner").

According to another aspect, the one or more further amino acid sequences may comprise one or more parts, fragments or domains of conventional 4-chain antibodies (and in particular human antibodies) and/or of heavy chain antibodies. For example, although usually less preferred, a Nanobody of the invention may be linked to a conventional (preferably human) $V_H$ or $V_L$ domain or to a natural or synthetic analog of a $V_H$ or $V_L$ domain, again optionally via a linker sequence (including but not limited to other (single) domain antibodies, such as the dAb's described by Ward et al. supra).

The at least one Nanobody may also be linked to one or more (preferably human) $C_H1$, $C_H2$ and/or $C_H3$ domains, optionally via a linker sequence. For instance, a Nanobody linked to a suitable $C_H1$ domain could for example be used—together with suitable light chains—to generate antibody fragments/structures analogous to conventional Fab fragments or F(ab')$_2$ fragments, but in which one or (in case of an F(ab')$_2$ fragment) one or both of the conventional $V_H$ domains have been replaced by a Nanobody of the invention. Also, two Nanobodies could be linked to a $C_H3$ domain (optionally via a linker) to provide a construct with increased half-life in vivo.

According to one specific aspect of a polypeptide of the invention, one or more Nanobodies of the invention may be linked (optionally via a suitable linker or hinge region) to one or more constant domains (for example, 2 or 3 constant domains that can be used as part of/to form an Fc portion), to an Fc portion and/or to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $C_H2$ and/or $C_H3$ domains of an antibody, such as from a heavy chain antibody (as described herein) and more preferably from a conventional human 4-chain antibody; and/or may form (part of) and Fc region, for example from IgG (e.g. from IgG1, IgG2, IgG3 or IgG4), from IgE or from another human Ig such as IgA, IgD or IgM. For example, WO 94/04678 describes heavy chain antibodies comprising a Camelid $V_{HH}$ domain or a humanized derivative thereof (i.e. a Nanobody), in which the Camelidae $C_H2$ and/or $C_H3$ domain have been replaced by human $C_H2$ and $C_H3$ domains, so as to provide an immunoglobulin that consists of 2 heavy chains each comprising a Nanobody and human $C_H2$ and $C_H3$ domains (but no $C_H1$ domain), which immunoglobulin has the effector function provided by the $C_H2$ and $C_H3$ domains and which immunoglobulin can function without the presence of any light chains. Other amino acid sequences that can be suitably linked to the Nanobodies of the invention so as to provide an effector function will be clear to the skilled person, and may be chosen on the basis of the desired effector function(s). Reference is for example made to WO 04/058820, WO 99/42077, WO 02/056910 and WO 05/017148, as well as the review by Holliger and Hudson, supra; and to the non-prepublished US provisional application by Ablynx N.V. entitled "Constructs comprising single variable domains and an Fc portion derived from IgE" which has a filing date of Dec. 4, 2007. Coupling of a Nanobody of the invention to an Fc portion may also lead to an increased half-life, compared to the corresponding Nanobody of the invention. For some applications, the use of an Fc portion and/or of constant domains (i.e. $C_H2$ and/or $C_H3$ domains) that confer increased half-life without any biologically significant effector function may also be suitable or even preferred. Other suitable constructs comprising one or more Nanobodies and one or more constant domains with increased half-life in vivo will be clear to the skilled person, and may for example comprise two Nanobodies linked to a $C_H3$ domain, optionally via a linker sequence. Generally, any fusion protein or derivatives with increased half-life will preferably have a molecular weight of more than 50 kD, the cut-off value for renal absorption.

In another one specific, but non-limiting, aspect, in order to form a polypeptide of the invention, one or more amino acid sequences of the invention may be linked (optionally via a suitable linker or hinge region) to naturally occurring, synthetic or semisynthetic constant domains (or analogs, variants, mutants, parts or fragments thereof) that have a reduced (or essentially no) tendency to self-associate into dimers (i.e. compared to constant domains that naturally occur in conventional 4-chain antibodies). Such monomeric (i.e. not self-associating) Fc chain variants, or fragments thereof, will be clear to the skilled person. For example, Helm et al., J Biol Chem 1996 271 7494, describe monomeric Fcε chain variants that can be used in the polypeptide chains of the invention.

Also, such monomeric Fc chain variants are preferably such that they are still capable of binding to the complement or the relevant Fc receptor(s) (depending on the Fc portion from which they are derived), and/or such that they still have some or all of the effector functions of the Fc portion from which they are derived (or at a reduced level still suitable for the intended use). Alternatively, in such a polypeptide chain of the invention, the monomeric Fc chain may be used to confer increased half-life upon the polypeptide chain, in which case the monomeric Fc chain may also have no or essentially no effector functions.

Bivalent/multivalent, bispecific/multispecific or biparatopic/multiparatopic polypeptides of the invention may also be linked to Fc portions, in order to provide polypeptide constructs of the type that is described in the non-prepublished U.S. provisional application U.S. 61/005, 331 entitled "immunoglobulin constructs" filed on Dec. 4, 2007.

The further amino acid sequences may also form a signal sequence or leader sequence that directs secretion of the Nanobody or the polypeptide of the invention from a host cell upon synthesis (for example to provide a pre-, pro- or prepro-form of the polypeptide of the invention, depending on the host cell used to express the polypeptide of the invention).

The further amino acid sequence may also form a sequence or signal that allows the Nanobody or polypeptide of the invention to be directed towards and/or to penetrate or enter into specific organs, tissues, cells, or parts or compartments of cells, and/or that allows the Nanobody or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, those mentioned on page 118 of WO 08/020,079. For some applications, in particular for those applications in which it is intended to kill a cell that expresses the target against which the Nanobodies of the invention are directed (e.g. in the treatment of cancer), or to reduce or slow the growth and/or proliferation of such a cell, the Nanobodies of the invention may also be linked to a (cyto)toxic protein or polypeptide. Examples of such toxic proteins and polypeptides which can be linked to a Nanobody of the invention to provide—for example—a cytotoxic polypeptide of the invention will be clear to the skilled person and can for example be found in the prior art cited above and/or in the further description herein. One example is the so-called ADEPT™ technology described in WO 03/055527.

According to one preferred, but non-limiting aspect, said one or more further amino acid sequences comprise at least one further Nanobody, so as to provide a polypeptide of the invention that comprises at least two, such as three, four, five or more Nanobodies, in which said Nanobodies may optionally be linked via one or more linker sequences (as defined herein). As described on pages 119 and 120 of WO 08/020, 079, polypeptides of the invention that comprise two or more Nanobodies, of which at least one is a Nanobody of the invention, will also be referred to herein as "multivalent" polypeptides of the invention, and the Nanobodies present in such polypeptides will also be referred to herein as being in a "multivalent format". For example, "bivalent" and "trivalent" polypeptides of the invention may be as further described on pages 119 and 120 of WO 08/020,079.

Polypeptides of the invention that contain at least two Nanobodies, in which at least one Nanobody is directed against a first antigen (i.e. against HER3) and at least one Nanobody is directed against a second antigen (i.e. different from HER3), will also be referred to as "multispecific" polypeptides of the invention, and the Nanobodies present in such polypeptides will also be referred to herein as being in a "multispecific format". Thus, for example, a "bispecific" polypeptide of the invention is a polypeptide that comprises at least one Nanobody directed against a first antigen (i.e. HER3) and at least one further Nanobody directed against a second antigen (i.e. different from HER3), whereas a "trispecific" polypeptide of the invention is a polypeptide that comprises at least one Nanobody directed against a first antigen (i.e. HER3), at least one further Nanobody directed against a second antigen (i.e. different from HER3) and at least one further Nanobody directed against a third antigen (i.e. different from both HER3, and the second antigen); etc.

Accordingly, in its simplest form, a bispecific polypeptide of the invention is a bivalent polypeptide of the invention (as defined herein), comprising a first Nanobody directed against HER3, and a second Nanobody directed against a second antigen, in which said first and second Nanobody may optionally be linked via a linker sequence (as defined herein); whereas a trispecific polypeptide of the invention in its simplest form is a trivalent polypeptide of the invention (as defined herein), comprising a first Nanobody directed against HER3, a second Nanobody directed against a second antigen and a third Nanobody directed against a third antigen, in which said first, second and third Nanobody may optionally be linked via one or more, and in particular one and more, in particular two, linker sequences.

However, as will be clear from the description hereinabove, the invention is not limited thereto, in the sense that a multispecific polypeptide of the invention may comprise at least one Nanobody against HER3, and any number of Nanobodies directed against one or more antigens different from HER3.

Furthermore, although it is encompassed within the scope of the invention that the specific order or arrangement of the various Nanobodies in the polypeptides of the invention may have some influence on the properties of the final polypeptide of the invention (including but not limited to the affinity, specificity or avidity for HER3, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant Nanobodies, unless explicitly indicated otherwise.

Finally, it is also within the scope of the invention that the polypeptides of the invention contain two or more Nanobodies and one or more further amino acid sequences (as mentioned herein).

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

One preferred, but non-limiting example of a multispecific polypeptide of the invention comprises at least one Nanobody of the invention and at least one Nanobody that provides for an increased half-life. Such Nanobodies may for example be Nanobodies that are directed against a serum protein, and in particular a human serum protein, such as human serum albumin, thyroxine-binding protein, (human) transferrin, fibrinogen, an immunoglobulin such as IgG, IgE or IgM, or against one of the serum proteins listed in WO 04/003019. Of these, Nanobodies that can bind to serum albumin (and in particular human serum albumin) or to IgG (and in particular human IgG, see for example Nanobody VH-1 described in the review by Muyldermans, supra) are particularly preferred (although for example, for experiments in mice or primates, Nanobodies against or cross-reactive with mouse serum albumin (MSA) or serum albumin from said primate, respectively, can be used. However, for pharmaceutical use, Nanobodies against human serum albumin or human IgG will usually be preferred). Nanobodies that provide for increased half-life and that can be used in the polypeptides of the invention include the Nanobodies directed against serum albumin that are described in WO 04/041865, in WO 06/122787 and in the further patent applications by Ablynx N.V., such as those mentioned above.

For example, some preferred Nanobodies that provide for increased half-life for use in the present invention include Nanobodies that can bind to amino acid residues on (human) serum albumin that are not involved in binding of serum albumin to FcRn (see for example WO 06/0122787); Nanobodies that are capable of binding to amino acid residues on serum albumin that do not form part of domain III of serum albumin (see for example WO 06/0122787); Nanobodies that have or can provide an increased half-life (see for example WO 08/028,977 by Ablynx N.V mentioned herein); Nanobodies against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*)) (see for example WO 08/028,977 by Ablynx N.V)); Nanobodies that can bind to serum albumin in a pH independent manner (see for example WO2008/043821 by Ablynx N.V. mentioned herein) and/or Nanobodies that are conditional binders (see for example WO 08/043,822 by Ablynx N.V.).

Some particularly preferred Nanobodies that provide for increased half-life and that can be used in the polypeptides of the invention include the Nanobodies ALB-1 to ALB-10 disclosed in WO 06/122787 (see Tables II and III) of which ALB-8 (SEQ ID NO: 62 in WO 06/122787, see also SEQ ID NO: 11 of this application) is particularly preferred.

Some preferred, but non-limiting examples of polypeptides of the invention that comprise at least one Nanobody of the invention and at least one Nanobody that provides for increased half-life are given in SEQ ID NO's 147 to 327, more preferably HER3MS00135 (SEQ ID NO:282), HER3MS00212 (SEQ ID NO:319) or HER3MS00215 (SEQ ID NO:322).

According to a specific, but non-limiting aspect of the invention, the polypeptides of the invention contain, besides the one or more Nanobodies of the invention, at least one Nanobody against human serum albumin.

Generally, any polypeptides of the invention with increased half-life that contain one or more Nanobodies of the invention, and any derivatives of Nanobodies of the invention or of such polypeptides that have an increased half-life, preferably have a half-life that is at least 1.5 times, preferably at least 2 times, such as at least 5 times, for example at least 10 times or more than 20 times, greater than the half-life of the corresponding Nanobody of the invention per se. For example, such a derivative or polypeptides with increased half-life may have a half-life that is increased with more than 1 hours, preferably more than 2 hours, more preferably more than 6 hours, such as more than 12 hours, or even more than 24, 48 or 72 hours, compared to the corresponding Nanobody of the invention per se.

In a preferred, but non-limiting aspect of the invention, such derivatives or polypeptides may exhibit a serum half-life in human of at least about 12 hours, preferably at least 24 hours, more preferably at least 48 hours, even more preferably at least 72 hours or more. For example, such derivatives or polypeptides may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

According to one aspect of the invention the polypeptides are capable of binding to one or more molecules which can increase the half-life of the polypeptide in vivo.

The polypeptides of the invention are stabilised in vivo and their half-life increased by binding to molecules which resist degradation and/or clearance or sequestration. Typically, such molecules are naturally occurring proteins which themselves have a long half-life in vivo.

In the polypeptides of the invention, the one or more Nanobodies and the one or more polypeptides may be directly linked to each other (as for example described in WO 99/23221) and/or may be linked to each other via one or more suitable spacers or linkers, or any combination thereof.

Suitable spacers or linkers for use in multivalent and multispecific polypeptides will be clear to the skilled person, and may generally be any linker or spacer used in the art to link amino acid sequences. Preferably, said linker or spacer is suitable for use in constructing proteins or polypeptides that are intended for pharmaceutical use.

Some particularly preferred spacers include the spacers and linkers that are used in the art to link antibody fragments or antibody domains. These include the linkers mentioned in the general background art cited above, as well as for example linkers that are used in the art to construct diabodies or ScFv fragments (in this respect, however, its should be noted that, whereas in diabodies and in ScFv fragments, the linker sequence used should have a length, a degree of flexibility and other properties that allow the pertinent $V_H$ and $V_L$ domains to come together to form the complete antigen-binding site, there is no particular limitation on the length or the flexibility of the linker used in the polypeptide of the invention, since each Nanobody by itself forms a complete antigen-binding site).

For example, a linker may be a suitable amino acid sequence, and in particular amino acid sequences of between 1 and 50, preferably between 1 and 30, such as between 1 and 10 amino acid residues. Some preferred examples of such amino acid sequences include gly-ser linkers, for example of the type $(gly_x ser_y)_z$, such as (for example $(gly_4 ser)_3$ or $(gly_3 ser_2)_3$, as described in WO 99/42077 and the GS30, GS15, GS9 and GS7 linkers described in the applications by Ablynx mentioned herein (see for example WO 06/040153 and WO 06/122825), as well as hinge-like regions, such as the hinge regions of naturally occurring heavy chain antibodies or similar sequences (such as described in WO 94/04678).

Some other particularly preferred linkers are poly-alanine (such as AAA), as well as the linkers GS30 (SEQ ID NO: 85 in WO 06/122825) and GS9 (SEQ ID NO: 84 in WO 06/122825).

Other suitable linkers generally comprise organic compounds or polymers, in particular those suitable for use in proteins for pharmaceutical use. For instance, poly(ethyleneglycol) moieties have been used to link antibody domains, see for example WO 04/081026.

It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for HER3, or for one or more of the other antigens. Based on the disclosure herein, the skilled person will be able to determine the optimal linker(s) for use in a specific polypeptide of the invention, optionally after some limited routine experiments.

For example, in multivalent polypeptides of the invention that comprise Nanobodies directed against a multimeric antigen (such as a multimeric receptor or other protein), the length and flexibility of the linker are preferably such that it allows each Nanobody of the invention present in the polypeptide to bind to the antigenic determinant on each of the subunits of the multimer. Similarly, in a multispecific polypeptide of the invention that comprises Nanobodies directed against two or more different antigenic determinants on the same antigen (for example against different epitopes of an antigen and/or against different subunits of a multimeric receptor, channel or protein), the length and flexibility of the linker are preferably such that it allows each Nanobody to bind to its intended antigenic determinant. Again, based on the disclosure herein, the skilled person will be able to determine the optimal linker(s) for use in a specific polypeptide of the invention, optionally after some limited routine experiments.

It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the Nanobodies of the invention). For example, linkers containing one or more charged amino acid residues (see Table A-2 on page 48 of the International application WO 08/020,079) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments.

Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments.

Usually, for easy of expression and production, a polypeptide of the invention will be a linear polypeptide. However, the invention in its broadest sense is not limited thererto. For example, when a polypeptide of the invention comprises three of more Nanobodies, it is possible to link them by use of a linker with three or more "arms", which each "arm" being linked to a Nanobody, so as to provide a "star-shaped" construct. It is also possible, although usually less preferred, to use circular constructs.

The invention also comprises derivatives of the polypeptides of the invention, which may be essentially analogous to the derivatives of the Nanobodies of the invention, i.e. as described herein.

The invention also comprises proteins or polypeptides that "essentially consist" of a polypeptide of the invention (in which the wording "essentially consist of" has essentially the same meaning as indicated above).

According to one aspect of the invention, the polypeptide of the invention is in essentially isolated from, as defined herein.

The amino acid sequences, Nanobodies, polypeptides and nucleic acids of the invention can be prepared in a manner known per se, as will be clear to the skilled person from the further description herein. For example, the Nanobodies and polypeptides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, ISV's, Nanobodies, polypeptides and nucleic acids include the methods and techniques described herein.

As will be clear to the skilled person, one particularly useful method for preparing an amino acid sequence, ISV, Nanobody and/or a polypeptide of the invention generally comprises the steps of:
i) the expression, in a suitable host cell or host organism (also referred to herein as a "host of the invention") or in another suitable expression system of a nucleic acid that encodes said amino acid sequence, ISV, Nanobody or polypeptide of the invention (also referred to herein as a "nucleic acid of the invention"), optionally followed by:
ii) isolating and/or purifying the amino acid sequence, ISV, Nanobody or polypeptide of the invention thus obtained.

In particular, such a method may comprise the steps of:
i) cultivating and/or maintaining a host of the invention under conditions that are such that said host of the invention expresses and/or produces at least one amino acid sequence, ISV, Nanobody and/or polypeptide of the invention; optionally followed by:
ii) isolating and/or purifying the amino acid sequence, ISV, Nanobody or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism).

According to one aspect of the invention, the nucleic acid of the invention is in essentially isolated from, as defined herein.

The nucleic acid of the invention may also be in the form of, be present in and/or be part of a vector, such as for example a plasmid, cosmid or YAC, which again may be in essentially isolated form.

The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so at to provide a nucleic acid of the invention encoding said analog. Also, as will be clear to the skilled person, to prepare a nucleic acid of the invention, also several nucleotide sequences, such as at least one nucleotide sequence encoding a Nanobody and for example nucleic acids encoding one or more linkers can be linked together in a suitable manner.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers, using for example a sequence of a naturally occurring form of HER3 as a template. These and other techniques will be clear to the skilled person, and reference is again made to the standard handbooks, such as Sambrook et al. and Ausubel et al., mentioned above, as well as the Examples below.

The nucleic acid of the invention may also be in the form of, be present in and/or be part of a genetic construct, as will be clear to the person skilled in the art and as described on pages 131-134 of WO 08/020,079 (incorporated herein by reference). Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention".

The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting aspect, a genetic construct of the invention comprises
i) at least one nucleic acid of the invention; operably connected to
ii) one or more regulatory elements, such as a promoter and optionally a suitable terminator;
and optionally also
iii) one or more further elements of genetic constructs known per se;
in which the terms "operably connected" and "operably linked" have the meaning given on pages 131-134 of WO 08/020,079; and in which the "regulatory elements", "promoter", "terminator" and "further elements" are as described on pages 131-134 of WO 08/020,079; and in which the genetic constructs may further be as described on pages 131-134 of WO 08/020,079.

The nucleic acids of the invention and/or the genetic constructs of the invention may be used to transform a host cell or host organism, i.e. for expression and/or production of the amino acid sequence, ISV, Nanobody or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example those described on pages 134 and 135 of WO 08/020,079; as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, Nanobodies and polypeptides of the invention can also be introduced and expressed in one or more cells, tissues or organs of a multicellular organism, for example for prophylactic and/or therapeutic purposes (e.g. as a gene therapy), as further described on pages 135 and 136 of in WO 08/020,079, and in the further references cited in WO 08/020,079.

For expression of the ISV or Nanobodies in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, ISV, Nanobodies and polypeptides of the invention can for example also be produced in the milk of transgenic mammals, for example in the milk of rabbits, cows, goats or sheep (see for example U.S. Pat. No. 6,741,957, U.S. Pat. No. 6,304,489 and U.S. Pat. No. 6,849,992 for general techniques for introducing transgenes into mammals), in plants or parts of plants including but not limited to their leaves, flowers, fruits, seed, roots or turbers (for example in tobacco, maize, soybean or alfalfa) or in for example pupae of the silkworm *Bombix mori.*

Furthermore, the amino acid sequences, ISV, Nanobodies and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of ISV or Nanobodies is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person. As also will be clear to the skilled person, polypeptides of the invention suitable for pharmaceutical use can be prepared using techniques for peptide synthesis.

For production on industrial scale, preferred heterologous hosts for the (industrial) production of ISV's, Nanobodies or Nanobody-containing protein therapeutics include strains of *E. coli, Pichia pastoris, S. cerevisiae* that are suitable for large scale expression/production/fermentation, and in particular for large scale pharmaceutical (i.e. GMP grade) expression/production/fermentation. Suitable examples of such strains will be clear to the skilled person. Such strains and production/expression systems are also made available by companies such as Biovitrum (Uppsala, Sweden).

Alternatively, mammalian cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above.

The choice of the specific expression system would depend in part on the requirement for certain post-translational modifications, more specifically glycosylation. The production of an ISV- or Nanobody-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, ISV, Nanobody or polypeptide to be obtained.

Thus, according to one non-limiting aspect of the invention, the amino acid sequence, ISV, Nanobody or polypeptide of the invention is glycosylated. According to another non-limiting aspect of the invention, the amino acid sequence, ISV, Nanobody or polypeptide of the invention is non-glycosylated.

According to one preferred, but non-limiting aspect of the invention, the amino acid sequence, ISV, Nanobody or polypeptide of the invention is produced in a bacterial cell, in particular a bacterial cell suitable for large scale pharmaceutical production, such as cells of the strains mentioned above.

According to another preferred, but non-limiting aspect of the invention, the amino acid sequence, ISV, Nanobody or polypeptide of the invention is produced in a yeast cell, in particular a yeast cell suitable for large scale pharmaceutical production, such as cells of the species mentioned above.

According to yet another preferred, but non-limiting aspect of the invention, the amino acid sequence, ISV, Nanobody or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove.

As further described on pages 138 and 139 of WO 08/020,079, when expression in a host cell is used to produce the amino acid sequences, ISV's, Nanobodies and the polypeptides of the invention, the amino acid sequences, ISV's, Nanobodies and polypeptides of the invention can be produced either intracellullarly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. Thus, according to one non-limiting aspect of the invention, the amino acid sequence, ISV, Nanobody or polypeptide of the invention is an amino acid sequence, ISV, Nanobody or polypeptide that has been produced intracellularly and that has been isolated from the host cell, and in particular from a bacterial cell or from an inclusion body in a bacterial cell. According to another non-limiting aspect of the invention, the amino acid sequence, ISV, Nanobody or polypeptide of the invention is an amino acid sequence, ISV, Nanobody or polypeptide that has been produced extracellularly, and that has been isolated from the medium in which the host cell is cultivated.

Some preferred, but non-limiting promoters for use with these host cells include those mentioned on pages 139 and 140 of WO 08/020,079.

Some preferred, but non-limiting secretory sequences for use with these host cells include those mentioned on page 140 of WO 08/020,079.

Suitable techniques for transforming a host or host cell of the invention will be clear to the skilled person and may depend on the intended host cell/host organism and the genetic construct to be used. Reference is again made to the handbooks and patent applications mentioned above.

After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies.

The transformed host cell (which may be in the form or a stable cell line) or host organisms (which may be in the form of a stable mutant line or strain) form further aspects of the present invention.

Preferably, these host cells or host organisms are such that they express, or are (at least) capable of expressing (e.g. under suitable conditions), an amino acid sequence, ISV, Nanobody or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction.

To produce/obtain expression of the amino acid sequences of the invention, the transformed host cell or transformed host organism may generally be kept, maintained and/or cultured under conditions such that the (desired) amino acid sequence, ISV, Nanobody or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention.

Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, ISV, Nanobody or polypeptide of the invention may (first) be generated in an immature form (as mentioned above), which may then be subjected to post-translational modification, depending on the host cell/host organism used. Also, the amino acid sequence, ISV, Nanobody or polypeptide of the invention may be glycosylated, again depending on the host cell/host organism used.

The amino acid sequence, ISV, Nanobody or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, ISV, Nanobody or polypeptide of the invention) and/or preparative immunological techniques (i.e. using antibodies against the amino acid sequence to be isolated).

Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein.

Thus, in a further aspect, the invention relates to a pharmaceutical composition that contains at least one amino acid of the invention, at least one ISV of the invention, at least one Nanobody of the invention or at least one polypeptide of the invention and at least one suitable carrier, diluent or excipient (i.e. suitable for pharmaceutical use), and optionally one or more further active substances.

Generally, the amino acid sequences, ISV's, Nanobodies and polypeptides of the invention can be formulated and administered in any suitable manner known per se, for which reference is for example made to the general background art cited above (and in particular to WO 04/041862, WO 04/041863, WO 04/041865, WO 04/041867 and WO 08/020,079) as well as to the standard handbooks, such as Remington's Pharmaceutical Sciences, 18$^{th}$ Ed., Mack Publishing Company, USA (1990), Remington, the Science and Practice of Pharmacy, 21th Edition, Lippincott Williams and Wilkins (2005); or the Handbook of Therapeutic Antibodies (S. Dubel, Ed.), Wiley, Weinheim, 2007 (see for example pages 252-255).

For example, the amino acid sequences, ISV's, Nanobodies and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intra-arterial or intrathecal administration) or for topical (i.e. transdermal or intradermal) administration.

Preparations for parenteral administration may for example be sterile solutions, suspensions, dispersions or emulsions that are suitable for infusion or injection. Suitable carriers or diluents for such preparations for example include, without limitation, those mentioned on page 143 of WO 08/020,079. Usually, aqueous solutions or suspensions will be preferred.

The amino acid sequences, ISV's, Nanobodies and polypeptides of the invention can also be administered using gene therapy methods of delivery. See, e.g., U.S. Pat. No. 5,399,346, which is incorporated by reference in its entirety.

Using a gene therapy method of delivery, primary cells transfected with the gene encoding an amino acid sequence, ISV, Nanobody or polypeptide of the invention can additionally be transfected with tissue specific promoters to target specific organs, tissue, grafts, tumors, or cells and can additionally be transfected with signal and stabilization sequences for subcellularly localized expression.

Thus, the amino acid sequences, ISV's, Nanobodies and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, ISV's, Nanobodies and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, Nanobody or polypeptide of the invention. Their percentage in the compositions and preparations may, of course, be varied and may conveniently be between about 2 to about 60% of the weight of a given unit dosage form. The amount of the amino acid sequence, ISV, Nanobody or polypeptide of the invention in such therapeutically useful compositions is such that an effective dosage level will be obtained.

The tablets, troches, pills, capsules, and the like may also contain binders, excipients, disintegrating agents, lubricants and sweetening or flavouring agents, for example those mentioned on pages 143-144 of WO 08/020,079. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, ISV's, Nanobodies and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, ISV's, Nanobodies and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract.

The amino acid sequences, ISV's, Nanobodies and polypeptides of the invention may also be administered intravenously or intraperitoneally by infusion or injection, as further described on pages 144 and 145 of WO 08/020,079.

For topical administration, the amino acid sequences, ISV's, Nanobodies and polypeptides of the invention may be applied in pure form, i.e., when they are liquids. However, it will generally be desirable to administer them to the skin as compositions or formulations, in combination with a dermatologically acceptable carrier, which may be a solid or a liquid, as further described on page 145 of WO 08/020,079.

Generally, the concentration of the amino acid sequences, ISV's, Nanobodies and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%.

The amount of the amino acid sequences, ISV's, Nanobodies and polypeptides of the invention required for use in treatment will vary not only with the particular amino acid sequence, ISV, Nanobody or polypeptide selected but also with the route of administration, the nature of the condition being treated and the age and condition of the patient and will be ultimately at the discretion of the attendant physician or clinician. Also the dosage of the amino acid sequences, ISV's, Nanobodies and polypeptides of the invention varies depending on the target cell, tumor, tissue, graft, or organ.

The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye.

An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4), Mack Publishing Co., Easton, Pa. The dosage can also be adjusted by the individual physician in the event of any complication.

In another aspect, the invention relates to a method for the prevention and/or treatment of at least one variety of cancers, said method comprising administering, to a subject in need thereof, a pharmaceutically active amount of an amino acid sequence of the invention, of an ISV of the invention, of a Nanobody of the invention, of a polypeptide of the invention, and/or of a pharmaceutical composition comprising the same.

In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention relates to a method for the prevention and/or treatment of at least one disease or disorder that is associated with HER3, with its biological or pharmacological activity, and/or with the biological pathways or signalling in which HER3 is involved, said method comprising administering, to a subject in need thereof, a pharmaceutically active amount of an amino acid sequence of the invention, of an ISV of the invention, of a Nanobody of the invention, of a polypeptide of the invention, and/or of a pharmaceutical composition comprising the same. In particular, the invention relates to a method for the prevention and/or treatment of at least one disease or disorder that can be treated by modulating HER3, its biological or pharmacological activity, and/or the biological pathways or signalling in which HER3 is involved, said method comprising administering, to a subject in need thereof, a pharmaceutically active amount of an amino acid sequence of the invention, of an ISV of the invention, of a Nanobody of the invention, of a polypeptide of the invention, and/or of a pharmaceutical composition comprising the same. In particular, said pharmaceutically effective amount may be an amount that is sufficient to modulate HER3, its biological or pharmacological activity, and/or the biological pathways or signalling in which HER3 is involved; and/or an amount that provides a level of the amino acid sequence of the invention, of an ISV of the invention, of a Nanobody of the invention, of a polypeptide of the invention in the circulation that is sufficient to modulate HER3, its biological or pharmacological activity, and/or the biological pathways or signalling in which HER3 is involved.

The invention furthermore relates to a method for the prevention and/or treatment of at least one disease or disorder that can be prevented and/or treated by administering an amino acid sequence of the invention, of an ISV of the invention, a Nanobody of the invention or a polypeptide of the invention to a patient, said method comprising administering, to a subject in need thereof, a pharmaceutically active amount of an amino acid sequence of the invention, of an ISV of the invention, of a Nanobody of the invention, of a polypeptide of the invention, and/or of a pharmaceutical composition comprising the same.

More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of an ISV of the invention, of a Nanobody of the invention, of a polypeptide of the invention, and/or of a pharmaceutical composition comprising the same.

In another aspect, the invention relates to a method for immunotherapy, and in particular for passive immunotherapy, which method comprises administering, to a subject suffering from or at risk of the diseases and disorders mentioned herein, a pharmaceutically active amount of an amino acid sequence of the invention, of an ISV of the invention, of a Nanobody of the invention, of a polypeptide of the invention, and/or of a pharmaceutical composition comprising the same.

In the above methods, the amino acid sequences, ISV's, Nanobodies and/or polypeptides of the invention and/or the compositions comprising the same can be administered in any suitable manner, depending on the specific pharmaceutical formulation or composition to be used. Thus, the amino acid sequences, ISV's, Nanobodies and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

The amino acid sequences, ISV's, Nanobodies and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequence, ISV, Nanobody or polypeptide of the invention to be used, the specific route of administration and pharmaceutical formulation or composition to be used, the age, gender, weight, diet, general condition of the patient, and similar factors well known to the clinician.

Generally, the treatment regimen will comprise the administration of one or more amino acid sequences, ISV's, Nanobodies and/or polypeptides of the invention, or of one or more compositions comprising the same, in one or more pharmaceutically effective amounts or doses. The specific amount(s) or doses to administer can be determined by the clinician, again based on the factors cited above.

Generally, for the prevention and/or treatment of the diseases and disorders mentioned herein and depending on the specific disease or disorder to be treated, the potency of the specific amino acid sequence, ISV, Nanobody and polypeptide of the invention to be used, the specific route of administration and the specific pharmaceutical formulation or composition used, the amino acid sequences, ISV's, Nanobodies and polypeptides of the invention will generally be administered in an amount between 1 gram and 0.01 milligram per kg body weight per day, preferably between 0.1 gram and 0.01 milligram per kg body weight per day, such as about 0.1, 1, 10, 100 or 1000 milligram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

Usually, in the above method, a single amino acid sequence, ISV, Nanobody or polypeptide of the invention will be used. It is however within the scope of the invention to use two or more amino acid sequences, ISV's, Nanobodies and/or polypeptides of the invention in combination.

The ISV's, Nanobodies, amino acid sequences and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement.

In particular, the amino acid sequences, ISV's, Nanobodies and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a case-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand.

Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, ISV, Nanobody or polypeptide of the invention in the preparation of a pharmaceutical composition for prevention and/or treatment of at least one variety of cancers; and/or for use in one or more of the methods of treatment mentioned herein.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention also relates to the use of an amino acid sequence, ISV, Nanobody or polypeptide of the invention in the preparation of a pharmaceutical composition for the prevention and/or treatment of at least one disease or disorder that can be prevented and/or treated by administering an amino acid sequence, ISV, Nanobody or polypeptide of the invention to a patient.

More in particular, the invention relates to the use of an amino acid sequence, ISV, Nanobody or polypeptide of the invention in the preparation of a pharmaceutical composition for the prevention and/or treatment of variety of cancers, and in particular for the prevention and treatment of one or more of the diseases and disorders listed herein.

Again, in such a pharmaceutical composition, the one or more amino acid sequences, ISV's, Nanobodies or polypeptides of the invention may also be suitably combined with one or more other active principles, such as those mentioned herein.

Finally, although the use of the ISV's or Nanobodies of the invention (as defined herein) and of the polypeptides of the invention is much preferred, it will be clear that on the basis of the description herein, the skilled person will also be able to design and/or generate, in an analogous manner, other amino acid sequences and in particular (single) domain antibodies against HER3, as well as polypeptides comprising such (single) domain antibodies.

For example, it will also be clear to the skilled person that it may be possible to "graft" one or more of the CDR's mentioned above for the Nanobodies of the invention onto such (single) domain antibodies or other protein scaffolds, including but not limited to human scaffolds or non-immunoglobulin scaffolds. Suitable scaffolds and techniques for such CDR grafting will be clear to the skilled person and are well known in the art, see for example those mentioned in WO 08/020,079. For example, techniques known per se for grafting mouse or rat CDR's onto human frameworks and scaffolds can be used in an analogous manner to provide chimeric proteins comprising one or more of the CDR's of the Nanobodies of the invention and one or more human framework regions or sequences.

It should also be noted that, when the Nanobodies of the inventions contain one or more other CDR sequences than the preferred CDR sequences mentioned above, these CDR sequences can be obtained in any manner known per se, for example using one or more of the techniques described in WO 08/020,079.

Further uses of the amino acid sequences, ISV's, Nanobodies, polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify HER3 from compositions and preparations comprising the same. Derivatives of the amino acid sequences of the invention that comprise a suitable detectable label can also be used as markers to determine (qualitatively or quantitatively) the presence of HER3 in a composition or preparation or as a marker to selectively detect the presence of HER3 on the surface of a cell or tissue (for example, in combination with suitable cell sorting techniques).

The invention will now be further described by means of the following non-limiting preferred aspects, examples and figures:

Preferred Aspects:

Aspect A-1: An immunoglobulin single variable domain that is directed against and/or that can specifically bind to HER3.

Aspect A-2: An immunoglobulin single variable domain according to aspect A-1, that is in essentially isolated form.

Aspect A-3: An immunoglobulin single variable domain according to aspect A-1 or A-2, for administration to a subject, wherein said immunoglobulin single variable domain does not naturally occur in said subject.

Aspect A-4: An immunoglobulin single variable domain that can specifically bind to HER3 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter. Such an immunoglobulin single variable domain may in particular be an immunoglobulin single variable domain according to any of the preceding aspects.

Aspect A-5: An immunoglobulin single variable domain that can specifically bind to HER3 with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$. Such an immunoglobulin single variable domain may in particular be an immunoglobulin single variable domain according to any of the preceding aspects.

Aspect A-6: An immunoglobulin single variable domain that can specifically bind to HER3 with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$. Such an immunoglobulin single variable domain may in particular be an immunoglobulin single variable domain according to any of the preceding aspects.

Aspect A-7: An immunoglobulin single variable domain that can specifically bind to HER3 with an affinity less than 500 nM, preferably less than 200 nM, more preferably less than 10 nM, such as less than 1 nM. Such an immunoglobulin single variable domain may in particular be an immunoglobulin single variable domain according to any of the preceding aspects.

Aspect A-8: An immunoglobulin single variable domain according to any of the preceding aspects, that is a naturally occurring immunoglobulin single variable domain (from any suitable species) or a synthetic or semi-synthetic immunoglobulin single variable domain.

Aspect A-9: An immunoglobulin single variable domain according to any of the preceding aspects, that comprises an immunoglobulin fold or that under suitable conditions is capable of forming an immunoglobulin fold.

Aspect A-10: An immunoglobulin single variable domain according to any of the preceding aspects, that essentially consists of 4 framework regions (FR1 to FR4 respectively) and 3 complementarity determining regions (CDR1 to CDR3 respectively).

Aspect A-11: An immunoglobulin single variable domain according to any of the preceding aspects, that is an immunoglobulin sequence.

Aspect A-12: An immunoglobulin single variable domain according to any of the preceding aspects, that is a naturally occurring immunoglobulin sequence (from any suitable species) or a synthetic or semi-synthetic immunoglobulin sequence.

Aspect A-13: An immunoglobulin single variable domain according to any of the preceding aspects that is a humanized immunoglobulin sequence, a camelized immunoglobulin sequence or an immunoglobulin sequence that has been obtained by techniques such as affinity maturation.

Aspect A-14: An immunoglobulin single variable domain according to any of the preceding aspects, that essentially consists of a light chain variable domain sequence (e.g. a VL-sequence); or of a heavy chain variable domain sequence (e.g. a VH-sequence).

Aspect A-15: An immunoglobulin single variable domain according to any of the preceding aspects, that essentially consists of a heavy chain variable domain sequence that is derived from a conventional four-chain antibody or that essentially consists of a heavy chain variable domain sequence that is derived from a heavy chain antibody.

Aspect A-16: An immunoglobulin single variable domain according to any of the preceding aspects, that essentially consists of a domain antibody (or an immunoglobulin single variable domain that is suitable for use as a domain antibody), of a single domain antibody (or an immunoglobulin single variable domain that is suitable for use as a single domain antibody), of a "dAb" (or an immunoglobulin single variable domain that is suitable for use as a dAb) or of a Immunoglobulin single variable domain (including but not limited to a VHH sequence).

Aspect A-17: An immunoglobulin single variable domain according to any of the preceding aspects, that essentially consists of an immunoglobulin single variable domain.

Aspect A-18: An immunoglobulin single variable domain according to any of the preceding aspects, that essentially consists of an immunoglobulin single variable domain that has preferably one or more of the amino acid residues at positions 11, 37, 44, 45, 47, 83, 84, 103, 104 and 108 according to the Kabat numbering chosen from the Hallmark residues mentioned in Table B-2.

Aspect A-19: An immunoglobulin single variable domain according to any of the preceding aspects, that essentially consists of a polypeptide that i) has at least 80% amino acid identity with at least one of the immunoglobulin single variable domains of SEQ ID NO's: 12 to 26, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-20: An immunoglobulin single variable domain according to any of the preceding aspects, that essentially consists of an immunoglobulin single variable domain that i) has at least 80% amino acid identity with at least one of the immunoglobulin single variable domains of SEQ ID NO's: 12 to 26, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-21: An immunoglobulin single variable domain according to any of the preceding aspects, that essentially consists of a humanized or otherwise sequence optimized immunoglobulin single variable domain.

Aspect A-22: An immunoglobulin single variable domain according to any of the preceding aspects, that in addition to the at least one binding site for binding against/to HER3, contains one or more further binding sites for binding against/to other antigens, proteins or targets.

Aspect B-1: An immunoglobulin single variable domain that is directed against and/or that can specifically bind HER3, and that comprises one or more stretches of amino acid residues chosen from the group consisting of:
  a) the amino acid sequences of SEQ ID NO's: 57 to 71;
  b) amino acid sequences that have at least 80% amino acid identity with at least one of the amino acid sequences of SEQ ID NO's: 57 to 71;
  c) amino acid sequences that have 3, 2, or 1 amino acid difference with at least one of the amino acid sequences of SEQ ID NO's: 57 to 71;
  d) the amino acid sequences of SEQ ID NO's: 87 to 101;
  e) amino acid sequences that have at least 80% amino acid identity with at least one of the amino acid sequences of SEQ ID NO's: 87 to 101;
  f) amino acid sequences that have 3, 2, or 1 amino acid difference with at least one of the amino acid sequences of SEQ ID NO's: 87 to 101;
  g) the amino acid sequences of SEQ ID NO's: 117 to 131;
  h) amino acid sequences that have at least 80% amino acid identity with at least one of the amino acid sequences of SEQ ID NO's: 117 to 131;
  i) amino acid sequences that have 3, 2, or 1 amino acid difference with at least one of the amino acid sequences of SEQ ID NO's: 117 to 131;
  or any suitable combination thereof.
  Such an immunoglobulin single variable domain may in particular be an immunoglobulin single variable domain according to any of the aspects A-1 to A-22.

Aspect B-2: An immunoglobulin single variable domain according to aspect B-1, in which at least one of said stretches of amino acid residues forms part of the antigen binding site for binding against/to HER3.

Aspect B-3: An immunoglobulin single variable domain sequence that is directed against and/or that can specifically bind HER3 and that comprises two or more stretches of amino acid residues chosen from the group consisting of:
  a) the amino acid sequences of SEQ ID NO's: 57 to 71;
  b) amino acid sequences that have at least 80% amino acid identity with at least one of the amino acid sequences of SEQ ID NO's: 57 to 71;
  c) amino acid sequences that have 3, 2, or 1 amino acid difference with at least one of the amino acid sequences of SEQ ID NO's: 57 to 71;
  d) the amino acid sequences of SEQ ID NO's: 87 to 101;
  e) amino acid sequences that have at least 80% amino acid identity with at least one of the amino acid sequences of SEQ ID NO's: 87 to 101;
  f) amino acid sequences that have 3, 2, or 1 amino acid difference with at least one of the amino acid sequences of SEQ ID NO's: 87 to 101;
  g) the amino acid sequences of SEQ ID NO's: 117 to 131;
  h) amino acid sequences that have at least 80% amino acid identity with at least one of the amino acid sequences of SEQ ID NO's: 117 to 131;
  i) amino acid sequences that have 3, 2, or 1 amino acid difference with at least one of the amino acid sequences of SEQ ID NO's: 117 to 131;
  such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).
  Such an immunoglobulin single variable domain may in particular be an immunoglobulin single variable domain according to any of the aspects A-1 to A-22, B-1 or B-2.

Aspect B-4: An immunoglobulin single variable domain according to aspect B-3, in which the at least two stretches of amino acid residues forms part of the antigen binding site for binding against HER3.

Aspect B-5: An immunoglobulin single variable domain sequence that is directed against and/or that can specifically bind HER3 and that comprises three or more stretches of amino acid residues, in which the first stretch of amino acid residues is chosen from the group consisting of:
  a) the amino acid sequences of SEQ ID NO's: 57 to 71;
  b) amino acid sequences that have at least 80% amino acid identity with at least one of the amino acid sequences of SEQ ID NO's: 57 to 71;
  c) amino acid sequences that have 3, 2, or 1 amino acid difference with at least one of the amino acid sequences of SEQ ID NO's: 57 to 71;
  the second stretch of amino acid residues is chosen from the group consisting of:
  d) the amino acid sequences of SEQ ID NO's: 87 to 101;
  e) amino acid sequences that have at least 80% amino acid identity with at least one of the amino acid sequences of SEQ ID NO's: 87 to 101;
  f) amino acid sequences that have 3, 2, or 1 amino acid difference with at least one of the amino acid sequences of SEQ ID NO's: 87 to 101;
  and the third stretch of amino acid residues is chosen from the group consisting of:
  g) the amino acid sequences of SEQ ID NO's: 117 to 131;
  h) amino acid sequences that have at least 80% amino acid identity with at least one of the amino acid sequences of SEQ ID NO's: 117 to 131;
  i) amino acid sequences that have 3, 2, or 1 amino acid difference with at least one of the amino acid sequences of SEQ ID NO's: 117 to 131.
  Such an immunoglobulin single variable domain may in particular be an immunoglobulin single variable domain according to any of the aspects A-1 to A-22 and/or B-1 to B-4.

Aspect B-6: An immunoglobulin single variable domain according to aspect B-5, in which the at least three stretches of amino acid residues forms part of the antigen binding site for binding against/to HER3.

Aspect B-7: An immunoglobulin single variable domain that is directed against and/or that can specifically bind HER3 in which the CDR sequences of said immunoglobulin single variable domain have at least 70% amino acid identity, preferably at least 80% amino acid identity, more preferably at least 90% amino acid identity, such as 95% amino acid identity or more or even essentially 100% amino acid identity with the CDR sequences of at least one of the immunoglobulin single variable domains of SEQ ID NO's: 12 to 26. Such an immunoglobulin single variable domain may in particular be an immunoglobulin single variable domain according to any of the aspects A-1 to A-22 and/or B-1 to B-6.

Aspect C-1: An immunoglobulin single variable domain that is directed against HER3 and that cross-blocks the binding of at least one of the immunoglobulin single variable domains of SEQ ID NO's: 12 to 26 to HER3. Such an immunoglobulin single variable domain may in particular be an immunoglobulin single variable domain according to any of the aspects A-1 to A-22 and/or according to aspects B-1 to B-7. Also, preferably, such an immunoglobulin single variable domain is able to specifically bind to HER3.

Aspect C-2: An immunoglobulin single variable domain that is directed against HER3 and that is cross-blocked from binding to HER3 by at least one of the immunoglobulin single variable domains of SEQ ID NO's: 12 to 26. Such an immunoglobulin single variable domain may in particular be an immunoglobulin single variable domain according to any of the aspects A-1 to A-22 and/or according to aspects B-1 to B-7. Also, preferably, such an immunoglobulin single variable domain is able to specifically bind to HER3.

Aspect C-3: An immunoglobulin single variable domain according to any of aspects C-1 or C-2, wherein the ability of said immunoglobulin single variable domain to cross-block or to be cross-blocked is detected in a FACS competition assay, e.g. as described in the experimental part.

Aspect C-4: An immunoglobulin single variable domain according to any of aspects C-1 to C-3, wherein the ability of said immunoglobulin single variable domain to cross-block or to be cross-blocked is detected in an ELISA assay.

Aspect D-1: An immunoglobulin single variable domain according to any of aspects B-1 to B-7 or C-1 to C-4, that is in essentially isolated form.

Aspect D-2: An immunoglobulin single variable domain according to any of aspects B-1 to B-7, C-1 to C-4, and/or D1 for administration to a subject, wherein said immunoglobulin single variable domain does not naturally occur in said subject.

Aspect D-3: An immunoglobulin single variable domain according to any of aspects B-1 to B-7, C-1 to C-4, and/or D1 to D-2 that can specifically bind to HER3 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect D-4: An immunoglobulin single variable domain according to any of aspects B-1 to B-7, C-1 to C-4, and/or D-1 to D-3 that can specifically bind to HER3 with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect D-5: An immunoglobulin single variable domain according to any of aspects B-1 to B-7, C-1 to C-4, and/or D-1 to D-4 that can specifically bind to HER3 with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect D-6: An immunoglobulin single variable domain according to any of aspects B-1 to B-7, C-1 to C-4, and/or D-1 to D-5 that can specifically bind to HER3 with an affinity less than 500 nM, preferably less than 100 nM, more preferably less than 10 nM, such as less than 1 nM.

The immunoglobulin single variable domains according to aspects D-1 to D-6 may in particular be an immunoglobulin single variable domain according to any of the aspects A-1 to A-22.

Aspect E-1: An immunoglobulin single variable domain according to any of aspects B-1 to B-7, C-1 to C-4 and/or D1 to D-6, that is a naturally occurring immunoglobulin single variable domain (from any suitable species) or a synthetic or semi-synthetic immunoglobulin single variable domain.

Aspect E-2: An immunoglobulin single variable domain according to any of aspects B-1 to B-7, C-1 to C-4, D1 to D-6, and/or E-1 that comprises an immunoglobulin fold or that under suitable conditions is capable of forming an immunoglobulin fold.

Aspect E-3: An immunoglobulin single variable domain according to any of aspects B-1 to B-7, C-1 to C-4, D1 to D-6, and/or D-1 or D-2, that is an immunoglobulin sequence.

Aspect E-4: An immunoglobulin single variable domain according to any of aspects B-1 to B-7, C-1 to C-4, D1 to D-6, and/or E-1 to E-3, that is a naturally occurring immunoglobulin sequence (from any suitable species) or a synthetic or semi-synthetic immunoglobulin sequence.

Aspect E-5: An immunoglobulin single variable domain according to any of aspects B-1 to B-7, C-1 to C-4, D1 to D-6, and/or E-1 to E-4 that is a humanized immunoglobulin sequence, a camelized immunoglobulin sequence or an immunoglobulin sequence that has been obtained by techniques such as affinity maturation.

Aspect E-6: An immunoglobulin single variable domain according to any of aspects B-1 to B-7, C-1 to C-4, D1 to D-6, and/or E-1 to E-5 that essentially consists of a light chain variable domain sequence (e.g. a $V_L$-sequence); or of a heavy chain variable domain sequence (e.g. a $V_H$-sequence).

Aspect E-7: An immunoglobulin single variable domain according to any of aspects B-1 to B-7, C-1 to C-4, D1 to D-6, and/or E-1 to E-6, that essentially consists of a heavy chain variable domain sequence that is derived from a conventional four-chain antibody or that essentially consist of a heavy chain variable domain sequence that is derived from heavy chain antibody.

Aspect E-8: An immunoglobulin single variable domain according to any of aspects B-1 to B-7, C-1 to C-4, D1 to D-6, and/or E-1 to E-7, that essentially consists of a domain antibody (or an immunoglobulin single variable domain that is suitable for use as a domain antibody), of a single domain antibody (or an immunoglobulin single variable domain that is suitable for use as a single domain antibody), of a "dAb" (or an immunoglobulin single variable domain that is suitable for use as a dAb) or of an immunoglobulin single variable domain (including but not limited to a $V_{HH}$ sequence).

Aspect E-9: An immunoglobulin single variable domain according to any of aspects B-1 to B-7, C-1 to C-4, D1 to D-6, and/or E-1 to E-8 that essentially consists of a VHH or engineered VHH.

Aspect E-10: An immunoglobulin single variable domain according to any of aspects B-1 to B-7, C-1 to C-4, D1 to D-6, and/or E-1 to E-9 that essentially consists of a VHH or engineered VHH that has preferably one or more of the amino acid residues at positions 11, 37, 44, 45, 47, 83, 84, 103, 104 and 108 according to the Kabat numbering are chosen from the Hallmark residues mentioned in Table B-2.

Aspect E-11: An immunoglobulin single variable domain according to any of aspects B-1 to B-7, C-1 to C-4, D1 to D-6, and/or E-1 to E-10, that essentially consists of a VHH or engineered VHH that
i) has at least 80% amino acid identity with at least one of the immunoglobulin single variable domains of SEQ ID NO's: 12 to 26, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect E-12: An immunoglobulin single variable domain according to any of aspects B-1 to B-7, C-1 to C-4, D1 to D-6, and/or E-1 to E-11 that essentially consists of a VHH or engineered VHH.

Aspect E-13: An immunoglobulin single variable domain according to any of the aspects B-1 to B-7, C-1 to C-4, D1 to D-6, and/or E-1 to E-11, that in addition to the at least one stretch of amino acid residues or binding site for binding formed by the CDR sequences, contains one or more further binding sites for binding against other antigens, proteins or targets.

The immunoglobulin single variable domains according to aspects E-1 to E-13 may in particular be an immunoglobulin single variable domain according to any of the aspects A-1 to A-22.

Aspect F-1: An immunoglobulin single variable domain that essentially consists of 4 framework regions (FR1 to FR4, respectively) and 3 complementarity determining regions (CDR1 to CDR3, respectively), in which:
CDR1 is chosen from the group consisting of:
  a) the immunoglobulin single variable domains of SEQ ID NO's: 57 to 71;
  b) immunoglobulin single variable domains that have at least 80% amino acid identity with at least one of the immunoglobulin single variable domains of SEQ ID NO's: 57 to 71;
  c) immunoglobulin single variable domains that have 3, 2, or 1 amino acid difference with at least one of the immunoglobulin single variable domains of SEQ ID NO's: 57 to 71;
  and/or
CDR2 is chosen from the group consisting of:
  d) the immunoglobulin single variable domains of SEQ ID NO's: 87 to 101;
  e) immunoglobulin single variable domains that have at least 80% amino acid identity with at least one of the immunoglobulin single variable domains of SEQ ID NO's: 87 to 101;
  f) immunoglobulin single variable domains that have 3, 2, or 1 amino acid difference with at least one of the immunoglobulin single variable domains of SEQ ID NO's: 87 to 101;
  and/or
CDR3 is chosen from the group consisting of:
  g) the immunoglobulin single variable domains of SEQ ID NO's: 117 to 131;
  h) immunoglobulin single variable domains that have at least 80% amino acid identity with at least one of the immunoglobulin single variable domains of SEQ ID NO's: 117 to 131;
  i) immunoglobulin single variable domains that have 3, 2, or 1 amino acid difference with at least one of the immunoglobulin single variable domains of SEQ ID NO's: 117 to 131.

Such an immunoglobulin single variable domain is preferably directed against HER3 and/or an immunoglobulin single variable domain that can specifically bind to HER3. Also, such an immunoglobulin single variable domain is preferably an immunoglobulin single variable domain according to any of the aspects A-1 to A-22, C-1 to C-4, D1 to D-6 and/or E-1 to E-13.

Aspect F-2: An immunoglobulin single variable domain that essentially consists of 4 framework regions (FR1 to FR4, respectively) and 3 complementarity determining regions (CDR1 to CDR3, respectively), in which:
CDR1 is chosen from the group consisting of:
  a) the immunoglobulin single variable domains of SEQ ID NO's: 57 to 71;
  b) immunoglobulin single variable domains that have at least 80% amino acid identity with at least one of the immunoglobulin single variable domains of SEQ ID NO's: 57 to 71;
  c) immunoglobulin single variable domains that have 3, 2, or 1 amino acid difference with at least one of the immunoglobulin single variable domains of SEQ ID NO's: 57 to 71;
  and
CDR2 is chosen from the group consisting of:
  d) the immunoglobulin single variable domains of SEQ ID NO's: 87 to 101;
  e) immunoglobulin single variable domains that have at least 80% amino acid identity with at least one of the immunoglobulin single variable domains of SEQ ID NO's: 87 to 101;
  f) immunoglobulin single variable domains that have 3, 2, or 1 amino acid difference with at least one of the immunoglobulin single variable domains of SEQ ID NO's: 87 to 101;
  and
CDR3 is chosen from the group consisting of:
  g) the immunoglobulin single variable domains of SEQ ID NO's: 117 to 131;
  h) immunoglobulin single variable domains that have at least 80% amino acid identity with at least one of the immunoglobulin single variable domains of SEQ ID NO's: 117 to 131;
  i) immunoglobulin single variable domains that have 3, 2, or 1 amino acid difference with at least one of the immunoglobulin single variable domains of SEQ ID NO's: 117 to 131.

Such an immunoglobulin single variable domain is preferably directed against HER3 and/or an immunoglobulin single variable domain that can specifically bind to HER3. Also, such an immunoglobulin single variable domain is preferably an immunoglobulin single variable domain according to any of the aspects A-1 to A-22, C-1 to C-4, D1 to D-6 and/or E-1 to E-13.

Aspect F-3: An immunoglobulin single variable domain according to any of aspects F-1 and F-2, in which the CDR sequences of said immunoglobulin single variable domain have at least 70% amino acid identity, preferably at least 80% amino acid identity, more preferably at least 90% amino acid identity, such as 95% amino acid identity or more or even essentially 100% amino acid identity with the CDR sequences of at least one of the immunoglobulin single variable domains of SEQ ID NO's: 12 to 26.

Such an immunoglobulin single variable domain is preferably directed against HER3 and/or an immunoglobulin single variable domain that can specifically bind to HER3. Also, such an immunoglobulin single variable domain is preferably an immunoglobulin single variable domain according to any of the aspects A-1 to A-22, C-1 to C-4, D1 to D-6 and/or E-1 to E-13.

Aspect F-4: An immunoglobulin single variable domain according to any of aspects F-1 to F-3 that is directed against HER3 and that cross-blocks the binding of at least one of the immunoglobulin single variable domains according to any of aspects the immunoglobulin single variable domains of SEQ ID NO's: 12 to 26.

Aspect F-5: An immunoglobulin single variable domain according to any of aspects F-1 to F-3 that is directed against HER3 and that is cross-blocked from binding to HER3 by at least one of the immunoglobulin single variable domains of SEQ ID NO's: 12 to 26.

Aspect F-6: Immunoglobulin single variable domain according to any of aspects F-4 or F-5 wherein the ability of said immunoglobulin single variable domain to cross-block or to be cross-blocked is detected in a FACS competition assay as e.g. shown in the experimental part.

Aspect F-7: Immunoglobulin single variable domain according to any of aspects F4 or F-5 wherein the ability of said immunoglobulin single variable domain to cross-block or to be cross-blocked is detected in an ELISA assay.

Aspect F-8: An immunoglobulin single variable domain according to any of aspects F-1 to F-7, that is in essentially isolated form.

Aspect F-9: An immunoglobulin single variable domain according to any of aspects F-1 to F-8, for administration to a subject, wherein said an immunoglobulin single variable domain does not naturally occur in said subject.

Aspect F-10: An immunoglobulin single variable domain according to any of aspects F-1 to F-9, that can specifically bind to HER3 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect F-11: An immunoglobulin single variable domain according to any of aspects F-1 to F-10, that can specifically bind to HER3 with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect F-12: An immunoglobulin single variable domain according to any of aspects F-1 to F-11, that can specifically bind to HER3 with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect F-13: An immunoglobulin single variable domain according to any of aspects F-1 to F-12, that can specifically bind to HER3 with an affinity less than 500 nM, preferably less than 200 nM, more preferably less than 10 nM, such as less than 1 nM.

Aspect F-14: An immunoglobulin single variable domain according to any of aspects F-1 to F-13, that is a naturally occurring immunoglobulin single variable domain (from any suitable species) or a synthetic or semi-synthetic immunoglobulin single variable domain.

Aspect F-15: An immunoglobulin single variable domain according to any of aspects F-1 to F-14, that comprises an immunoglobulin fold or that under suitable conditions is capable of forming an immunoglobulin fold.

Aspect F-16: An immunoglobulin single variable domain according to any of aspects F-1 to F-15, that is an immunoglobulin sequence.

Aspect F-17: An immunoglobulin single variable domain according to any of aspects F-1 to F-16, that is a naturally occurring immunoglobulin sequence (from any suitable species) or a synthetic or semi-synthetic immunoglobulin sequence.

Aspect F-18: An immunoglobulin single variable domain according to any of aspects F-1 to F-17, that is a humanized immunoglobulin sequence, a camelized immunoglobulin sequence or an immunoglobulin sequence that has been obtained by techniques such as affinity maturation.

Aspect F-19: An immunoglobulin single variable domain according to any of aspects F-1 to F-19, that essentially consists of a light chain variable domain sequence (e.g. a $V_L$-sequence); or of a heavy chain variable domain sequence (e.g. a $V_H$-sequence).

Aspect F-20: An immunoglobulin single variable domain according to any of aspects F-1 to F-19, that essentially consists of a heavy chain variable domain sequence that is derived from a conventional four-chain antibody or that essentially consist of a heavy chain variable domain sequence that is derived from heavy chain antibody.

Aspect F-21: An immunoglobulin single variable domain according to any of aspects F-1 to F-20, that essentially consists of a domain antibody (or an immunoglobulin single variable domain that is suitable for use as a domain antibody), of a single domain antibody (or an immunoglobulin single variable domain that is suitable for use as a single domain antibody), of a "dAb" (or an immunoglobulin single variable domain that is suitable for use as a dAb) or of a VHH or engineered VHH.

Aspect F-22: An immunoglobulin single variable domain according to any of aspects F-1 to F-21, that essentially consists of a VHH or engineered VHH.

Aspect F-23: An immunoglobulin single variable domain according to any of aspects F-1 to F-22, that essentially consists of a VHH or engineered VHH that has preferably one or more of the amino acid residues at positions 11, 37, 44, 45, 47, 83, 84, 103, 104 and 108 according to the Kabat numbering are chosen from the Hallmark residues mentioned in Table B-2.

Aspect F-24: An immunoglobulin single variable domain according to any of aspects F-1 to F-23, that essentially consists of an immunoglobulin single variable domain that
i) has at least 80% amino acid identity with at least one of the immunoglobulin single variable domains of SEQ ID NO's: 12 to 26, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect F-25: An immunoglobulin single variable domain according to any of aspects F-1 to F-24, that essentially consists of a sequence optimized VHH.

Aspect G-1: An immunoglobulin single variable domain according to any of the preceding aspects, that in addition to the at least one binding site for binding formed by the CDR sequences, contains one or more further binding sites for binding against another antigen, protein or target.

Aspect H-1: VHH that is directed against and/or that can specifically bind to HER3.

Aspect H-2: VHH according to aspect H-1, that is in essentially isolated form.

Aspect H-3: VHH according to any of aspects H-1 to H-2, that can specifically bind to HER3 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect H-4: VHH according to any of aspects H-1 to H-3, that can specifically bind to HER3 with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect H-5: VHH according to any of aspects H-1 to H-4, that can specifically bind to HER3 with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect H-6: VHH according to any of aspects H-1 to H-5, that can specifically bind to HER3 with an affinity less than 500 nM, preferably less than 200 nM, more preferably less than 10 nM, such as less than 500 pM.

Aspect H-7: VHH according to any of aspects H-1 to H-6, that is a naturally occurring VHH (from e.g. a llama) or a synthetic or semi-synthetic VHH.

Aspect H-8: VHH according to any of aspects to H-1 to H-7, that is a $V_{HH}$ sequence, a partially humanized $V_{HH}$ sequence, a fully humanized $V_{HH}$ sequence, a camelized heavy chain variable domain or a VHH that has been obtained by techniques such as affinity maturation.

Aspect H-9: VHH according to any of aspects H-1 to H-8, that has preferably one or more of the amino acid residues at positions 11, 37, 44, 45, 47, 83, 84, 103, 104 and 108 according to the Kabat numbering are chosen from the Hallmark residues mentioned in Table B-2.

Aspect H-10: VHH according to any of aspects H-1 to H-9, that
i) has at least 80% amino acid identity with at least one of the An immunoglobulin single variable domains of SEQ ID NO's: 12 to 26, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect H-11: VHH according to any of aspects H-1 to H-10, in which:
CDR1 is chosen from the group consisting of:
a) the immunoglobulin single variable domains of SEQ ID NO's: 57 to 71;
b) immunoglobulin single variable domains that have at least 80% amino acid identity with at least one of the immunoglobulin single variable domains of SEQ ID NO's: 57 to 71;
c) immunoglobulin single variable domains that have 3, 2, or 1 amino acid difference with at least one of the immunoglobulin single variable domains of SEQ ID NO's: 57 to 71;
and/or
CDR2 is chosen from the group consisting of:
d) the immunoglobulin single variable domains of SEQ ID NO's: 87 to 101;
e) immunoglobulin single variable domains that have at least 80% amino acid identity with at least one of the immunoglobulin single variable domains of SEQ ID NO's: 87 to 101;
f) immunoglobulin single variable domains that have 3, 2, or 1 amino acid difference with at least one of the immunoglobulin single variable domains of SEQ ID NO's: 87 to 101;
and/or
CDR3 is chosen from the group consisting of:
g) the immunoglobulin single variable domains of SEQ ID NO's: 117 to 131;
h) immunoglobulin single variable domains that have at least 80% amino acid identity with at least one of the immunoglobulin single variable domains of SEQ ID NO's: 117 to 131;
i) immunoglobulin single variable domains that have 3, 2, or 1 amino acid difference with at least one of the immunoglobulin single variable domains of SEQ ID NO's: 117 to 131.

Aspect H-12: VHH according to any of aspects H-1 to H-11, in which:
CDR1 is chosen from the group consisting of:
a) the immunoglobulin single variable domains of SEQ ID NO's: 57 to 71;
b) immunoglobulin single variable domains that have at least 80% amino acid identity with at least one of the immunoglobulin single variable domains of SEQ ID NO's: 57 to 71;
c) immunoglobulin single variable domains that have 3, 2, or 1 amino acid difference with at least one of the immunoglobulin single variable domains of SEQ ID NO's: 57 to 71;
and
CDR2 is chosen from the group consisting of:
d) the immunoglobulin single variable domains of SEQ ID NO's: 87 to 101;
e) immunoglobulin single variable domains that have at least 80% amino acid identity with at least one of the immunoglobulin single variable domains of SEQ ID NO's: 87 to 101;
f) immunoglobulin single variable domains that have 3, 2, or 1 amino acid difference with at least one of the immunoglobulin single variable domains of SEQ ID NO's: 87 to 101;
and
CDR3 is chosen from the group consisting of:
g) the immunoglobulin single variable domains of SEQ ID NO's: 117 to 131;
h) immunoglobulin single variable domains that have at least 80% amino acid identity with at least one of the immunoglobulin single variable domains of SEQ ID NO's: 117 to 131;
i) immunoglobulin single variable domains that have 3, 2, or 1 amino acid difference with at least one of the immunoglobulin single variable domains of SEQ ID NO's: 117 to 131.

Aspect H-13: VHH according to any of aspects H-1 to H-12, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the immunoglobulin single variable domains of SEQ ID NO's: 12 to 26.

Aspect H-14: VHH according to any of aspects H-1 to H-13, which is a partially humanized VHH.

Aspect H-15: VHH according to any of aspects H-1 to H-14, which is a fully humanized VHH.

Aspect H-16: VHH according to any of aspects H-1 to H-15, that is chosen from the group consisting of SEQ ID NO's: 12 to 26 or from the group consisting of from immunoglobulin single variable domains that have more than 80%, preferably more than 90%, more preferably more than 95%, such as 99% or more sequence identity (as defined herein) with at least one of the immunoglobulin single variable domains of SEQ ID NO's: 12 to 26.

Aspect H-17: VHH according to any of aspects H-1 to H-16, which is a humanized VHH.

Aspect H-18: VHH according to any of aspects H-1 to H-17, that is chosen from the group consisting of SEQ ID NO's: 12 to 26.

Aspect H-19: VHH directed against HER3 that cross-blocks the binding of at least one of the immunoglobulin single variable domains of SEQ ID NO's: 12 to 26 to HER3.

Aspect H-20: VHH directed against HER3 that is cross-blocked from binding to HER3 by at least one of the immunoglobulin single variable domains of SEQ ID NO's: 12 to 26.

Aspect H-21: VHH according to any of aspects H-19 or H-20 wherein the ability of said VHH to cross-block or to be cross-blocked is detected in a FACS competition assay, e.g. as described in the experimental part.

Aspect H-22: VHH according to any of aspects H-19 to H-21 wherein the ability of said VHH to cross-block or to be cross-blocked is detected in an ELISA assay.

Aspect K-1: Polypeptide that comprises or essentially consists of one or more immunoglobulin single variable domains according to any of aspects A-1 to A-22, B-1 to B-7, C-1 to C-4, D-1 to D-6, E-1 to E-13, F-1 to F-25, G-1 and/or one or more VHH according to any of aspects H-1 to H-22, and optionally further comprises one or more peptidic linkers and/or one or more other groups, residues, moieties or binding units.

Aspect K-2: Polypeptide according to aspect K-1, in which said one or more binding units are immunoglobulin sequences, and in particular ISV's.

Aspect K-3: Polypeptide according to any of aspects K-1 or K-2, in which said one or more other groups, residues, moieties or binding units are chosen from the group consisting of domain antibodies, immunoglobulin single variable domains that are suitable for use as a domain antibody, single domain antibodies, immunoglobulin single variable domains that are suitable for use as a single domain antibody, "dAb"'s, immunoglobulin single variable domains that are suitable for use as a dAb, or VHHs.

Aspect K-4: Polypeptide according to any of aspects K-1 to K-3, in which said one or more immunoglobulin single variable domains of the invention are immunoglobulin sequences.

Aspect K-5: Polypeptide according to any of aspects K-1 to K-4, in which said one or more immunoglobulin single variable domains of the invention are chosen from the group consisting of domain antibodies, immunoglobulin single variable domains that are suitable for use as a domain antibody, single domain antibodies, immunoglobulin single variable domains that are suitable for use as a single domain antibody, "dAb"'s, immunoglobulin single variable domains that are suitable for use as a dAb, or VHHs.

Aspect K-6: Polypeptide according to any of aspects K-1 to K-5, that comprises or essentially consists of one or more Nanobodies according to any of aspects H-1 to H-22 and in which said one or more other binding units are Nanobodies.

Aspect K-7: Polypeptide according to any of aspects K-1 to K-6, wherein at least one binding unit is a multivalent construct.

Aspect K-8: Polypeptide according to any of aspects K-1 to K-7, wherein at least one binding unit is a multiparatopic construct.

Aspect K-9: Polypeptide according to any of aspects K-1 to K-8, wherein at least one binding unit is a multispecific construct.

Aspect K-10: Polypeptide according to any of aspects K-1 to K-9, which has an increased half-life, compared to the corresponding immunoglobulin single variable domain according to any of aspects A-1 to A-22, B-1 to B-7, C-1 to C-4, D-1 to D-6, E-1 to E-13, F-1 to F-25 or G-1 per se or VHH according to any of aspects H-1 to H-22 per se, respectively.

Aspect K-11: Polypeptide according to aspect K-10, in which said one or more other binding units provide the polypeptide with increased half-life, compared to the corresponding immunoglobulin single variable domain according to any of aspects A-1 to A-22, B-1 to B-7, C-1 to C-4, D-1 to D-6, E-1 to E-13, F-1 to F-25 or G-1 per se or VHH according to any of aspects H-1 to H-22 per se, respectively.

Aspect K-12: Polypeptide according to aspect K-10 or K-11, in which said one or more other binding units that provide the polypeptide with increased half-life is chosen from the group consisting of serum proteins or fragments thereof, binding units that can bind to serum proteins, an Fc portion, and small proteins or peptides that can bind to serum proteins.

Aspect K-13: Polypeptide according to any of aspects K-10 to K-12, in which said one or more other binding units that provide the polypeptide with increased half-life is chosen from the group consisting of human serum albumin or fragments thereof.

Aspect K-14: Polypeptide according to any of aspect K-10 to K-13, in which said one or more other binding units that provides the polypeptide with increased half-life are chosen from the group consisting of binding units that can bind to serum albumin (such as human serum albumin) or a serum immunoglobulin (such as IgG).

Aspect K-15: Polypeptide according to any of aspects K-10 to K-14, in which said one or more other binding units that provides the polypeptide with increased half-life are chosen from the group consisting of domain antibodies, immunoglobulin single variable domains that are suitable for use as a domain antibody, single domain antibodies, immunoglobulin single variable domains that are suitable for use as a single domain antibody, "dAb"'s, immunoglobulin single variable domains that are suitable for use as a dAb, or VHHs that can bind to serum albumin (such as human serum albumin) or a serum immunoglobulin (such as IgG).

Aspect K-16: Polypeptide according to aspect K-10 to K-15, in which said one or more other binding units that provides the polypeptide with increased half-life is a VHH that can bind to serum albumin (such as human serum albumin) or a serum immunoglobulin (such as IgG).

Aspect K-17: Polypeptide according to any of aspects K-10 to K-16, that has a serum half-life that is at least 1.5 times, preferably at least 2 times, such as at least 5 times, for example at least 10 times or more than 20 times, greater than the half-life of the corresponding immunoglobulin single variable domain according to any of aspects A-1 to A-22, B-1 to B-7, C-1 to C-4, D-1 to D-6, E-1 to E-13, F-1 to F-25 or G-1 per se or a VHH according to any of aspects H-1 to H-22 per se, respectively.

Aspect K-18: Polypeptide according to any of aspects K-10 to K-17, that has a serum half-life that is increased with more than 1 hours, preferably more than 2 hours, more preferably more than 6 hours, such as more than 12 hours, or even more than 24, 48 or 72 hours, compared to the corresponding immunoglobulin single variable domain according to any of aspects A-1 to A-22, B-1 to B-7, C-1 to C-4, D-1 to D-6, E-1 to E-13, F-1 to F-25 or G-1 per se or a VHH according to any of aspects H-1 to H-22 per se, respectively.

Aspect K-19: Polypeptide according to any of aspects K-1 to K-18, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Aspect L-1: Compound or construct, that comprises or essentially consists of one or more immunoglobulin single variable domains according to any of aspects A-1 to A-22, B-1 to B-7, C-1 to C-4, D-1 to D-6, E-1 to E-13, F-1 to F-25 or G-1 and/or one or more VHHs according to any of aspects H-1 to H-22, and optionally further comprises one or more other groups, residues, moieties or binding units, optionally linked via one or more linkers.

Aspect L-2: Compound or construct according to aspects L-1, in which said one or more other groups, residues, moieties or binding units are immunoglobulin single variable domains.

Aspect L-3: Compound or construct according to aspect L-1 or L-2, in which said one or more linkers, if present, are one or more immunoglobulin single variable domains.

Aspect L-4: Compound or construct according to any of aspects L-1 to L-3, in which said one or more other groups, residues, moieties or binding units are immunoglobulin sequences.

Aspect L-5: Compound or construct according to any of aspects L-1 to L-4, in which said one or more other groups, residues, moieties or binding units are chosen from the group consisting of domain antibodies, immunoglobulin single variable domains that are suitable for use as a domain antibody, single domain antibodies, immunoglobulin single variable domains that are suitable for use as a single domain antibody, "dAb"'s, immunoglobulin single variable domains that are suitable for use as a dAb, or VHHs.

Aspect L-6: Compound or construct according to any of aspects L-1 to L-5, in which said one or more immunoglobulin single variable domains of the invention are immunoglobulin sequences.

Aspect L-7: Compound or construct according to any of aspects L-1 to L-6, in which said one or more immunoglobulin single variable domains of the invention are chosen from the group consisting of domain antibodies, immunoglobulin single variable domains that are suitable for use as a domain antibody, single domain antibodies, immunoglobulin single variable domains that are suitable for use as a single domain antibody, "dAb"'s, immunoglobulin single variable domains that are suitable for use as a dAb, or VHHs.

Aspect L-8: Compound or construct, that comprises or essentially consists of one or more VHH's or Nanobodies according to any of aspects H-1 to H-22 and in which said one or more other groups, residues, moieties or binding units are VHHs.

Aspect L-9: Compound or construct according to any of aspects L-1 to L-8, which is a multivalent construct.

Aspect L-10: Compound or construct according to any of aspects L-1 to L-9, which is a multispecific construct.

Aspect L-11: Compound or construct according to any of aspects L-1 to L-10, which has an increased half-life, compared to the corresponding immunoglobulin single variable domain according to any of aspects A-1 to A-22, B-1 to B-7, C-1 to C-4, D-1 to D-6, E-1 to E-13, F-1 to F-25 or G-1 per se or VHH according to any of aspects H-1 to H-22 per se, respectively.

Aspect L-12: Compound or construct according to aspect L-1 to L-11, in which said one or more other groups, residues, moieties or binding units provide the compound or construct with increased half-life, compared to the corresponding immunoglobulin single variable domain according to any of aspects A-1 to A-22, B-1 to B-7, C-1 to C-4, D-1 to D-6, E-1 to E-13, F-1 to F-25 or G-1 per se or VHH according to any of aspects H-1 to H-22 per se, respectively.

Aspect L-13: Compound or construct according to aspect L-12, in which said one or more other groups, residues, moieties or binding units that provide the compound or construct with increased half-life is chosen from the group consisting of serum proteins or fragments thereof, binding units that can bind to serum proteins, an Fc portion, and small proteins or peptides that can bind to serum proteins.

Aspect L-14: Compound or construct according to aspect L-12 or L-13, in which said one or more other groups, residues, moieties or binding units that provide the compound or construct with increased half-life is chosen from the group consisting of human serum albumin or fragments thereof.

Aspect L-15: Compound or construct according to any of aspects L-12 to L-14, in which said one or more other groups, residues, moieties or binding units that provides the compound or construct with increased half-life are chosen from the group consisting of binding units that can bind to serum albumin (such as human serum albumin) or a serum immunoglobulin (such as IgG).

Aspect L-16: Compound or construct according to any of aspects L-12 to L-14, in which said one or more other groups, residues, moieties or binding units that provides the compound or construct with increased half-life are chosen from the group consisting of domain antibodies, immunoglobulin single variable domains that are suitable for use as a domain antibody, single domain antibodies, immunoglobulin single variable domains that are suitable for use as a single domain antibody, "dAb"'s, immunoglobulin single variable domains that are suitable for use as a dAb, or VHHs that can bind to serum albumin (such as human serum albumin) or a serum immunoglobulin (such as IgG).

Aspect L-17: Compound or construct according to any of aspects L-12 to L-14, in which said one or more other groups, residues, moieties or binding units that provides the compound or construct with increased half-life is a VHH that can bind to serum albumin (such as human serum albumin) or a serum immunoglobulin (such as IgG).

Aspect L-18: Compound or construct according to any of aspects L-12 to L-17, that has a serum half-life that is at least 1.5 times, preferably at least 2 times, such as at least 5 times, for example at least 10 times or more than 20 times, greater than the half-life of the corresponding immunoglobulin single variable domain according to any of aspects A-1 to A-22, B-1 to B-7, C-1 to C-4, D-1 to D-6, E-1 to E-13, F-1 to F-25 or G-1 per se or VHH according to any of aspects H-1 to H-22 per se, respectively.

Aspect L-19: Compound or construct according to any of aspects L-12 to L-18, that has a serum half-life that is increased with more than 1 hours, preferably more than 2 hours, more preferably more than 6 hours, such as more than 12 hours, or even more than 24, 48 or 72 hours, compared to the corresponding immunoglobulin single variable domain according to any of aspects A-1 to A-22, B-1 to B-7, C-1 to C-4, D-1 to D-6, E-1 to E-13, F-1 to F-25 or G-1 per se or VHH according to any of aspects H-1 to H-22 per se, respectively.

Aspect L-20: Compound or construct according to any of aspects L-12 to L-19, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Aspect L-21: Monovalent construct, comprising or essentially consisting of one immunoglobulin single variable domain according to any of aspects A-1 to A-22, B-1 to B-7, C-1 to C-4, D-1 to D-6, E-1 to E-13, F-1 to F-25 or G-1 and/or one VHH according to any of aspects H-1 to H-22.

Aspect L-22: Monovalent construct according to aspect L-21, in which said immunoglobulin single variable domain of the invention is chosen from the group consisting of domain antibodies, immunoglobulin single variable domains that are suitable for use as a domain antibody, single domain antibodies, immunoglobulin single variable domains that are suitable for use as a single domain antibody, "dAb'"s, immunoglobulin single variable domains that are suitable for use as a dAb, or VHHs.

Aspect L-23: Monovalent construct, comprising or essentially consisting of one VHH according to any of aspects H-1 to H-22.

Aspect M-1: Nucleic acid or nucleotide sequence, that encodes an immunoglobulin single variable domain according to any of aspects A-1 to A-22, B-1 to C-4, D-1 to D-6, E-1 to E-13, F-1 to F-25 or G-1, a VHH according to any of aspects H-1 to H-22, a compound or construct according to any of aspects that is such that it can be obtained by expression of a nucleic acid or nucleotide sequence encoding the same; e.g. a nucleic acid or nucleotide sequence that has at least 70% sequence identity, preferably at least 80% sequence identity, more preferably at least 90% sequence identity, such as 95% sequence identity or more or even essentially 100% sequence identity with the sequences of at least one of the nucleic acid or nucleotide sequence of SEQ ID NO's: 27 to 41.

Aspect M-2: Nucleic acid or nucleotide sequence according to aspect M-1, that is in the form of a genetic construct.

Aspect N-1: Host or host cell that expresses, or that under suitable circumstances is capable of expressing, an immunoglobulin single variable domain according to any of aspects A-1 to A-22, B-1 to B-7, C-1 to C-4, D-1 to D-6, E-1 to E-13, F-1 to F-25 or G-1, a VHH according to any of aspects H-1 to H-22, a polypeptide according to any of aspects K-1 to K-19, a compound or construct according to any of aspects L-1 to L-21 that is such that it can be obtained by expression of a nucleic acid or nucleotide sequence encoding the same, or a monovalent construct according to any of aspects L-22 or L-23; and/or that comprises a nucleic acid or nucleotide sequence according to aspect M-1 or a genetic construct according to aspect M-2.

Aspect O-1: Composition comprising at least one immunoglobulin single variable domain according to any of aspects A-1 to A-22, B-1 to B-7, C-1 to C-4, D-1 to D-6, E-1 to E-13, F-1 to F-25 or G-1, a VHH according to any of aspects H-1 to H-22, a polypeptide according to any of aspects K-1 to K-19, a compound or construct according to any of aspects L-1 to L-21, monovalent construct according to any of aspects L-22 or L-23, or a nucleic acid or nucleotide sequence according to aspects M-1 or M-2.

Aspect O-2: Composition according to aspect O-1, which is a pharmaceutical composition.

Aspect O-3: Composition according to aspect O-2, which is a pharmaceutical composition, that further comprises at least one pharmaceutically acceptable carrier, diluent or excipient and/or adjuvant, and that optionally comprises one or more further pharmaceutically active polypeptides and/or compounds.

Aspect P-1: Method for producing an immunoglobulin single variable domain according to any of aspects A-1 to A-22, B-1 to B-7, C-1 to C-4, D-1 to D-6, E-1 to E-13, F-1 to F-25 or G-1, a VHH according to any of aspects H-1 to H-22, a polypeptide according to any of aspects K-1 to K-19, a compound or construct according to any of aspects L-1 to L-21 that is such that it can be obtained by expression of a nucleic acid or nucleotide sequence encoding the same, or a monovalent construct according to any of aspects L-22 or L-23, said method at least comprising the steps of:
a) expressing, in a suitable host cell or host organism or in another suitable expression system, a nucleic acid or nucleotide sequence according to aspect M-1, or a genetic construct according to aspect M-2;
optionally followed by:
b) isolating and/or purifying the immunoglobulin single variable domain according to any of aspects A-1 to A-22, B-1 to B-7, C-1 to C-4, D-1 to D-6, E-1 to E-13, F-1 to F-25 or G-1, a VHH according to any of aspects H-1 to H-22, a polypeptide according to any of aspects K-1 to K-19, a compound or construct according to any of aspects L-1 to L-21, or a monovalent construct according to any of aspects L-22 or L-23 thus obtained.

Aspect P-2: Method for producing an immunoglobulin single variable domain according to any of aspects A-1 to A-22, B-1 to B-7, C-1 to C-4, D-1 to D-6, E-1 to E-13, F-1 to F-25 or G-1, a VHH according to any of aspects H-1 to H-22, a polypeptide according to any of aspects K-1 to K-19, a compound or construct according to any of aspects L-1 to L-21 that is such that it can be obtained by expression of a nucleic acid or nucleotide sequence encoding the same, or a monovalent construct according to any of aspects L-22 or L-23, said method at least comprising the steps of:
   a) cultivating and/or maintaining a host or host cell according to aspect N1, under conditions that are such that said host or host cell expresses and/or produces at least one immunoglobulin single variable domain according to any of aspects A-1 to A-22, B-1 to B-7, C-1 to C-4, D-1 to D-6, E-1 to E-13, F-1 to F-25 or G-1, a VHH according to any of aspects H-1 to H-22, a polypeptide according to any of aspects K-1 to K-19, a compound or construct according to any of aspects L-1 to L-21, or monovalent construct according to any of aspects L-22 or L-23;
   optionally followed by:
   b) isolating and/or purifying the immunoglobulin single variable domain according to any of aspects A-1 to A-22, B-1 to B-7, C-1 to C-4, D-1 to D-6, E-1 to E-13, F-1 to F-25 or G-1, VHH according to any of aspects H-1 to H-22, a polypeptide according to any of aspects K-1 to K-19, a compound or construct according to any of aspects L-1 to L-21, or monovalent construct according to any of aspects L-22 or L-23 thus obtained.

Aspect Q-1: Method for screening immunoglobulin single variable domains directed against HER3 that comprises at least the steps of:
   a) providing a set, collection or library of nucleic acid sequences encoding immunoglobulin single variable domains;
   b) screening said set, collection or library of nucleic acid sequences for nucleic acid sequences that encode an immunoglobulin single variable domain that can bind to and/or has affinity for HER3 and that is cross-blocked or is cross blocking a Immunoglobulin single variable domain of the invention, e.g. SEQ ID NO: 12 to 26 (Table-A-1), or a humanized Immunoglobulin single variable domain of the invention, or a polypeptide or construct of the invention, e.g. SEQ ID NO: 147 to 327, more preferably HER3MS00135 (SEQ ID NO:282), HER3MS00212 (SEQ ID NO:319) or HER3MS00215 (SEQ ID NO:322). (see Table A-2); and
   c) isolating said nucleic acid sequence, followed by expressing said immunoglobulin single variable domain.

Aspect R-1: Method for the prevention and/or treatment of at least one variety of cancers, said method comprising administering, to a subject in need thereof, a pharmaceutically active amount of at least one immunoglobulin single variable domain according to any of aspects A-1 to A-22, B-1 to B-7, C-1 to C-4, D-1 to D-6, E-1 to E-13, F-1 to F-25 or G-1, VHH according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-2: Method for the prevention and/or treatment of at least one disease or disorder that is associated with HER3, with its biological or pharmacological activity, and/or with the biological pathways or signalling in which HER3 is involved, said method comprising administering, to a subject in need thereof, a pharmaceutically active amount of at least one immunoglobulin single variable domain according to any of aspects A-1 to A-22, B-1 to B-7, C-1 to C-4, D-1 to D-6, E-1 to E-13, F-1 to F-25 or G-1, VHH according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-3: Method for the prevention and/or treatment of at least one disease or disorder that can be prevented and/or treated by administering, to a subject in need thereof, at least one immunoglobulin single variable domain according to any of aspects A-1 to A-22, B-1 to B-7, C-1 to C-4, D-1 to D-6, E-1 to E-13, F-1 to F-25 or G-1, VHH according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3, said method comprising administering, to a subject in need thereof, a pharmaceutically active amount of at least one at least one immunoglobulin single variable domain according to any of aspects A-1 to A-22, B-1 to B-7, C-1 to C-4, D-1 to D-6, E-1 to E-13, F-1 to F-25 or G-1, VHH according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-4: Method for immunotherapy, said method comprising administering, to a subject in need thereof, a pharmaceutically active amount of at least one immunoglobulin single variable domain according to any of aspects A-1 to A-22, B-1 to B-7, C-1 to C-4, D-1 to D-6, E-1 to E-13, F-1 to F-25 or G-1, VHH according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-5: Use of an immunoglobulin single variable domain according to any of aspects A-1 to A-22, B-1 to B-7, C-1 to C-4, D-1 to D-6, E-1 to E-13, F-1 to F-25 or G-1, a VHH according to any of aspects H-1 to H-22, a polypeptide according to any of aspects K-1 to K-19, a compound or construct according to any of aspects L-1 to L-21, or a monovalent construct according to any of aspects L-22 or L-23 in the preparation of a pharmaceutical composition for prevention and/or treatment of at least one variety of cancers; and/or for use in one or more of the methods according to aspects R-1 to R-3.

Aspect R-6: Immunoglobulin single variable domain according to any of aspects A-1 to A-22, B-1 to B-7, C-1 to C-4, D-1 to D-6, E-1 to E-13, F-1 to F-25 or G-1, VHH according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3 for the prevention and/or treatment of at least one variety of cancers.

FIGURES

FIG. 1: nucleotide sequences encoding some of the amino acid sequences and polypeptides of the invention.

FIG. 2: FACS binding data of HER3-specific Nanobodies and control polyclonal (PC) and monoclonal (MC) antibodies and an irrelevant Nanobody (irr nb) to full length extracellular chicken HER3 or chimeric chicken-human HER3.

FIGS. 3A to 3D show binding curves showing that the multivalent sequence optimized Nanobodies bind to HER3 but not to the other HER proteins (see Example 25).

FIG. 4 gives the amino acid sequences of some of the proteins referred to in the present specification and claims.

FIGS. 5A and 5B show Western Blots showing the inhibition of pHER3 and downstream signalling in BT-474 breast cancer cells by formatted sequence optimized Nanobodies (Example 28).

EXPERIMENTAL PART

Example 1

Figure 2:
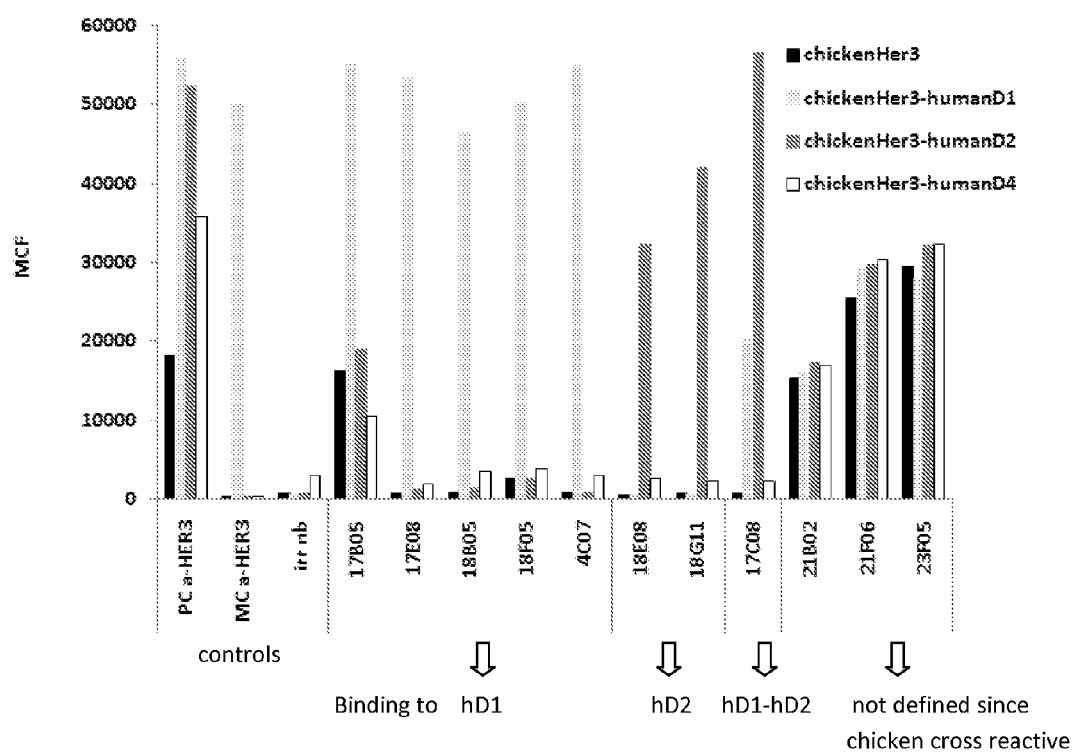

Materials 1.1 hHER3 ECD (=Human HER3 Extracellular Domain)—SEQ ID NO: 4.

The gene encoding the human HER3 extracellular domain was generated by in-vitro synthesis. The open reading frame contained the coding sequence of the cognate signal peptide of the HER3 gene followed by 624 amino acids of the extracellular domain (ECD), and a C-terminal 6H is tag (see SEQ ID NO: 4). The gene was cloned into the pEAK12d expression vector (Edge Biosystems). HER3ECD was produced by transient transfection of HEK293-EBNA cells (Invitrogen). Briefly, cells adapted for suspension growth in DMEM:F12 medium containing 4 ml/L Insulin-Transferrin-Selenium-X supplement and 1% Foetal Bovine Serum (all from Invitrogen) were incubated with a mixture of plasmid DNA and Poly-Ethylenelmine (PEI, PolySciences). After 90 min, transfected cells were diluted 1:1 in Freestyle medium (Invitrogen) and placed on an orbital shaker at 37° C. in a 5% CO2 incubator under agitation at 160 rpm. The supernatant was harvested after 6 days and sterile filtered through a 0.22 µm membrane cartridge (Millipore). The recombinant protein was purified on a Poros 20 MC metal chelate affinity chromatography column (Applied Biosystems) charged with Ni ions, followed by size exclusion chromatography in PBS on a HiLoad Superdex 75 prepgrade 16/60 column from GE Healthcare.

1.2 cHER3ECD (=*Maccaca fascicularis* HER3 Extracellular Domain=Cyno HER3ECD)—SEQ ID NO: 3

The cyno HER3 sequence was determined by RT-PCR and cDNA sequencing. The open reading frame contained the coding sequence of the cognate signal peptide of the cHER3 gene followed by 624 amino acids of the extracellular domain (ECD) and a C-terminal 6H is tag (SEQ ID No: 3). The gene was cloned into the pEAK12d expression vector (Edge Biosystems).

The HER3ECD was produced by transient transfection of HEK293-EBNA cells (Invitrogen). Briefly, cells adapted for suspension growth in DMEM:F12 medium containing 4 ml/L Insulin-Transferrin-Selenium-X supplement (all from Invitrogen) were incubated with plasmid DNA and Poly-Ethylenelmine (PEI, PolySciences) without pre-mixing. After 150 min, transfected cells were diluted 1:3 in Freestyle medium (Invitrogen) and placed on an orbital shaker at 37° C. in a 5% CO2 incubator under agitation at 80 rpm (radius 2.5 cm). Temperature was lowered to 34° C. after 24 h incubation. The supernatant was harvested after 5 days and sterile filtered through a 0.22 µm membrane cartridge (Millipore). The recombinant protein was purified on HisTrap HP metal chelate affinity chromatography column (GE Healthcare) charged with Ni ions, followed by dialysis against PBS.

1.3 hHER3 Full Length Sequence—SEQ ID NO: 1

The human HER3 sequence (SEQ ID No: 1) was synthetically produced and cloned into pcDNA3.1 and pcDNA5/FRT (Invitrogen) respectively. The final expression plasmid pcDNA3.1-hHER3 was used to generate HER3-expressing transfected cell lines.

1.4 Generation HER3 Expressing Transfectants

HEK 293T cells (DSMZ) were transient transfected with pcDNA3.1-hHER3 using Fugene HD (Roche) as transfection agent. Transfected cells were used to immunize llamas. Chinese hamster ovary cells (ATCC) were transfected with pcDNA3.1-hHER3, single cell sorted and selected for high and homogenous expression of HER3 by staining the cells using a HER3-specific monoclonal antibody (R&D Systems) and FACS analysis. One clone was selected and transfected with pcDNA3.1-hygro encoding human HER2 (SEQ ID NO: 9) to obtain HER2/HER3 double transfected cells. The cells were single cell sorted and a clone was selected with high and homogenous expression of HER2 by staining the cells using a HER2-specific monoclonal antibody (R&D Systems) and FACS analysis. These cells were used in binding and competition experiments.

FlpIn CHO cells (Invitrogen, #R-758-7) were transfected with pcDNA5/FRT-hHER3 plasmid and grown under hygromycin selection.

A camel cell line (CAKI; Nguyen et al. 2001. Adv. Immunol. 79: 261-296) was transfected with pcDNA3.1-hHER3 (SEQ ID NO: 1) and a single cell sorted clone was selected and used in selection experiments.

Example 2

Identification of HER3-Specific Nanobodies 2.1 Immunizations

After approval of the Ethical Committee of the Faculty of Veterinary Medicine (University Ghent, Belgium), 8 llamas were immunized, according to standard protocols. Three llamas (340, 342, 345) received 4 intramuscular injections at biweekly intervals of in-house made HER3-ECD (ECD: extracellular domain) SEQ ID NO: 4 with a dose of 100, 50, 25 and 25 microgram. Five llamas (419, 420, 421, 429, 430) received 4 subcutaneous injections at biweekly intervals of $2 \times 10^7$ transient transfected HEK293-HER3 cells.

2.2 Evaluation of Induced Responses in Llama

At the end of the immunization procedure, sera samples were collected from all animals to evaluate the induction of immune responses against HER3 by ELISA. In short, recombinant human HER3/Fc chimera was immobilized in a 96 well Maxisorp plate (Nunc, Wiesbaden, Germany). After blocking and addition of serum dilutions, specifically bound immunoglobulins were detected using monoclonal antibodies specific to llama IgG1, IgG2 or IgG3 and rabbit anti-mouse horseradish peroxidase conjugate. A significant HER3 specific immune response was observed in all animals. The antibody response was mounted both by the conventional and heavy chain only antibody B-cell repertoires since specifically bound immunoglobulins could be detected with antibodies specifically recognizing the conventional llama IgG1 antibodies or the heavy-chain only llama IgG2 and IgG3 antibodies.

TABLE C-1

Overview of the HER3-specific serum titers. The serum titer is defined as the highest serum dilution that results in a signal to noise 1 ≥ 2

| Llama ID | IgG1 | IgG2 | IgG3 |
|---|---|---|---|
| 340 - day 50 | 1.09E+06 | 3.65E+05 | 3.65E+05 |
| 342 - day 50 | 1.09E+06 | 1.22E+05 | 3.65E+05 |
| 345 - day 50 | 1.09E+06 | 4.05E+04 | 4.05E+04 |
| 419 - day 64 | 4.05E+04 | 1.50E+03 | 5.00E+02 |
| 420 - day 64 | 1.50E+03 | <500 | <500 |
| 421 - day 64 | 1.35E+04 | <500 | <500 |
| 429 - day 49 | 1.35E+04 | <500 | <500 |
| 430 - day 49 | 4.05E+04 | <500 | <500 |

[1]Signal to noise is defined as the ratio of OD450 nm absorptions of day blood collection after immunization (day 49, 50 or 64) versus pre-immune (day 0) serum sample.

2.3 Library Construction

Peripheral blood mononuclear cells were prepared from the blood samples using Ficoll-Hypaque according to the manufacturer's instructions. Total RNA extracted from these cells and from lymph nodes was used as starting material for RT-PCR to amplify Nanobody encoding gene fragments. These fragments were cloned into phagemid vector pAX50. Phage was prepared according to standard protocols (Phage Display of Peptides and Proteins: A Laboratory Manual, Academic Press; 1st edition (Oct. 28, 1996)) and stored after filter sterilization at 4° C. until further use. In total, 8 phage libraries were constructed (340, 342, 345, 419, 420, 421, 429 and 430), with library sizes between $3 \times 10^8$ and $8.5 \times 10^8$, and a percentage of insert ranging from 91 to 100%.

2.4 Selections in Search of HER3-Specific Nanobodies

To identify Nanobodies recognizing human HER3, the phage libraries were incubated with soluble biotinylated HER3-ECD (SEQ ID NO: 4). The protein was produced as described in Example 1 and biotinylated using Sulfo-NHS-LC-Biotin (Pierce). Complexes of biotinylated HER3 and phage were captured from solution on streptavidin coated magnetic beads. After extensive washing with PBS/0.05% Tween20, bound phage were eluted by addition of 1 mg/ml trypsin or 1 µM HRG (R&D systems). The phage libraries 340, 342 and 345 were incubated with soluble biotinylated human HER3-ECD (0.1-100 nM); phage libraries 419, 420, 421, 429 and 430 with soluble biotinylated human HER3-ECD (1-10-100-1000 nM) in two consecutive rounds. Outputs of these selections were analyzed for enrichment factor (number of phage present in eluate relative to controls) and individual clones from these first round outputs were picked. All phage libraries were also incubated with a Chinese hamster ovary (ATCC) or camel cell line (CAKI cells; Nguyen et al. 2001. Adv. Immunol. 79: 261-296)) transfected with hHER3 (hHER3=human HER3=SEQ ID NO: 1) or with hHER2 and hHER3 (hHER2=human HER2=SEQ ID NO: 9) ($5 \times 10^6$ cells) in two consecutive rounds. A third selection strategy consisted of coating plates with a HER3-specific Nanobody (04C07 and 21F06; 10 µg/ml), capture of HER3-ECD (5-100 nM) and addition of the phage libraries in order to enrich phages binding to different epitopes. Trypsin was used to elute phages and outputs were used as input for a second round selection on plates coated with the same or the alternative Nanobody. Individual clones were picked from the different selection conditions.

All individual clones were grown in 96 deep well plates (1 ml volume). Nanobody expression was induced by adding IPTG to a final concentration of 1 mM. Periplasmic extracts were prepared by freezing the cell pellets and dissolving them in 100 µl PBS. Cell debris was removed by centrifugation.

2.5 Screening for Nanobodies Binding hHER3

To determine the binding capacity of Nanobodies to hHER3, periplasmic extracts were screened in a cell based binding FACS assay (FACS Array, BectonDickinson). Samples were incubated with Chinese hamster ovary cells transfected with hHER3 or hHER2/hHER3, washed with FACS buffer and binding of the Nanobodies was detected using an anti-c-myc-specific antibody (Serotec). Nanobodies binding to hHER3 were identified.

2.6 Screening for Nanobodies Competing with HRG1-β1 Binding

To determine the HRG1-β1 (hHRG=human Heregulin) blocking capacity of the Nanobodies, periplasmic extracts were screened in a cell based competition assay using the FMAT technology (Applied Biosystems, Foster City, Calif.). HRG1-β1-EGF (R&D Systems, #396-HB, Accession # NP_039250) was labelled with A647 and incubated with Chinese hamster ovary cells transfected with hHER2/hHER3 in the presence of Nanobodies. Decrease in total FL1 signals indicates that the binding of labelled HRG1-β1 is blocked by the Nanobody present in the periplasmic extract. Nanobodies were identified with different levels of blocking the ligand-receptor interaction, ranging from 100% block to no block. Based on HER3 binding and HRG1-β1 competition screening, a set of HER3 Nanobodies was selected and sequenced. Sequence analysis revealed 204 different families of HER3 specific Nanobodies.

2.7 Surface Plasmon Resonance Analysis of Periplasmic Extracts on hHER3

Off-rates of the periplasmic extracts containing anti-HER3 Nanobodies were measured by Surface Plasmon Resonance (SPR) using a Biacore T100 instrument. Human HER3-ECD (SEQ ID NO: 4) was covalently bound to a CM sensor chip surface via amine coupling using EDC/NHS for activation and ethanolamine HCl for deactivation. Periplasmic extracts containing HER3-specific Nanobodies were injected for 2 minutes at a flow rate of 45 µl/min to allow binding to chip-bound antigen. Next, binding buffer without periplasmic extracts was sent over the chip at the same flow rate to allow spontaneous dissociation of bound Nanobody. From the sensorgrams obtained for the different periplasmic extracts $k_{off}$-values ($k_d$) were calculated.

2.8 Screening for Nanobodies Inhibiting Ligand Dependent HER3 Phosphorylation

To identify HER3-specific Nanobodies with a capacity to block HER3 phosphorylation, periplasmic extracts were incubated with serum-starved MCF-7 cells followed by 5 nM HRG1-β1-EGF stimulation for 15 minutes. Cell lysates were made and phosphorylation of HER3 was measured using the DuoSet IC human phospho-HER3ELISA (R&D systems, DYC1769-2). Nanobodies were identified with different levels of inhibiting the ligand-induced pHER3, ranging from 100% block to no inhibition.

2.9 Epitope Binning of Nanobodies

Six HER3-specific Nanobodies were biotinylated and used in alphascreen and/or FACS competition assays to group Nanobody families in different epitope bins. In the FACS assay, periplasmic extracts containing HER3-specific Nanobodies were incubated in presence of one out of the six biotinylated Nanobodies (used concentrations are indicated in Table C-2). The incubation mixtures were subsequently added to HER2/HER3 transfected CHO cells. After 90 minutes incubation, the cells were washed and binding of the biotinylated Nanobody was detected using streptavidin-PE. The obtained fluorescent signal is compared to the signal obtained from a condition where the biotinylated Nanobody was added to the cells without periplasmic extract Nanobody.

For the alphascreen competition assay, human HER3-Fc (R&D Systems, 348-RB) was captured on anti-human Fc Nanobody conjugated Acceptor beads which were prepared according to the manufacturer's instructions (PerkinElmer). To evaluate the blocking capacity of anti-HER3 Nanobodies, dilutions of the periplasmic extracts were added to one of the biotinylated Nanobodies (see Table C-2). To this mixture, human HER3-Fc-Acceptor beads were added and incubated for 1 hour at room temperature. Then, the streptavidin-coupled Donor beads were added and further incubated for 1 hour at room temperature. Fluorescence was measured using the EnVision Multilabel Plate Reader (PerkinElmer) using an excitation wavelength of 680 nm and an emission wavelength of 520 nm.

TABLE C-2

Concentrations of biotinylated Nanobodies used in epitope competition FACS and alphascreen and concentrations human HER3-Fc used in alphascreen.

| | FACS | Alphascreen | |
|---|---|---|---|
| | Concentration biotinylated Nanobody | Concentration hHER3-Fc | Concentration biotinylated Nanobody |
| 04C07 | 3 nM | 0.26 nM | 0.1 nM |
| 21B02 | 0.9 nM | 0.26 nM | 0.26 nM |
| 23F05 | 0.83 nM | 0.1 nM | 0.04 nM |
| 18E08 | 60 nM | 1.6 nM | 4 nM |
| 17C08 | 20 nM | NA | NA |
| 04F10 | 100 nM | NA | NA |

NA: not applicable

Non-competing Nanobodies were grouped in different epitope groups. Five different groups were identified based on the alphascreen and FACS competition results.

Example 3

Expression and Purification of hHER3-Specific Nanobodies

Based on the described screening assays, 15 Nanobodies were selected for further characterization. These Nanobodies belong to 13 different families and five different epitope bins. Sequences are shown in Table A-1 (SEQ ID NOs: 12 to 26).

Nanobodies were expressed in *E. coli* TG1 cells as c-myc, His6-tagged proteins in a culture volume of 500 mL. Expression was induced by addition of 1 mM IPTG and allowed to continue for 3 h at 37° C. After spinning the cell cultures, periplasmic extracts were prepared by freeze-thawing the pellets and resuspension in dPBS. These extracts were used as starting material for immobilized metal affinity chromatography (IMAC) using Histrap FF crude columns (GE Healthcare). Nanobodies were eluted from the column with 250 mM imidazole and subsequently desalted towards dPBS (Dulbecco's Phosphate Buffered Saline).

Example 4

Binding Capacity of Purified Nanobodies to hHER3 in ELISA

The binding capacity of 14 purified Nanobodies belonging to 5 different epitope bins was determined in ELISA. 96-well plates were coated with hHER3-ECD (1 µg/ml). A dilution series of each Nanobody starting from 500 nM down to 6 pM was tested and detected using mouse anti c-myc (Roche) and anti-mouse-HRP (Dako cytomation). All Nanobodies bind to hHER3-ECD and the obtained EC50 values are shown in Table C-3.

TABLE C-3

EC50 values for various anti-HER3 Nanobodies to hHER3-ECD and their 95% confidence intervals (CI) as determined by ELISA

| | SEQ ID NO | EC50 (nM) | CI95 |
|---|---|---|---|
| 04C07 | 15 | 0.86 | 0.5-1.6 |
| 05A09 | 19 | 1.45 | 0.92-2.3 |
| 17B05 | 13 | 0.63 | 0.35-1.13 |
| 17C08 | 20 | 0.62 | 0.4-0.96 |
| 17E08 | 25 | 1.02 | 0.48-2.15 |
| 18B05 | 14 | 0.4 | 0.2-0.83 |
| 18E08 | 17 | 4.7 | 3.3-6.8 |
| 18F05 | 12 | 0.29 | 0.15-0.55 |
| 18G11 | 16 | 0.72 | 0.39-1.33 |
| 21B02 | 21 | 1.1 | 0.7-1.6 |
| 21F06 | 22 | 0.3 | 0.14-0.65 |
| 23F05 | 23 | 0.46 | 0.28-0.77 |
| 34A04 | 24 | 0.57 | 0.35-0.92 |
| 34C07 | 18 | 0.46 | 0.26-0.8 |

Example 5

Affinity of Purified Nanobodies

Affinity measurements were performed using a Biacore T100 instrument by coating anti-human Fc antibody (GE Healthcare) to a CM sensorchip surface via amine coupling using EDC/NHS for activation and ethanolamine HCl for deactivation. HER3-Fc (R&D systems, 348-RB 5 µg/ml; 120 s; 10 µl/min) was injected to allow capturing by the coated anti-Fc antibody. Then, purified Nanobodies were injected for 2 minutes at a flow rate of 10 µl/min to allow binding to chip-bound antigen. Next, binding buffer without Nanobodies was sent over the chip at the same flow rate to allow spontaneous dissociation of bound Nanobody. The kinetic parameters $k_{on}$-values ($k_a$), $k_{off}$-values ($k_d$) and $K_D$ were calculated from the sensorgrams obtained for the different Nanobodies (Table C-4).

TABLE C-4

Kinetic parameters for purified HER3-specific Nanobodies.

| | $k_a$ (1/Ms) | $k_d$ (1/Ms) | KD (nM) |
|---|---|---|---|
| 04C07 | 1.20E+06 | 2.60E−04 | 0.22 |
| 17B05 | 3.90E+05 | 4.30E−05 | 0.11 |
| 17C08* | 8.40E+03 | 4.10E−04 | 48 |

TABLE C-4-continued

Kinetic parameters for purified HER3-specific Nanobodies.

|  | $k_a$ (1/Ms) | $k_d$ (1/Ms) | KD (nM) |
|---|---|---|---|
| 17E08 | 3.63E+05 | 4.10E−05 | 0.11 |
| 18B05 | 4.90E+05 | 1.42E−04 | 0.29 |
| 18E08 | 1.04E+04 | 5.61E−04 | 53.8 |
| 18F05 | 4.27E+05 | 1.04E−04 | 0.24 |
| 18G11 | 2.60E+04 | 2.70E−04 | 10 |
| 21B02 | 2.20E+06 | 2.60E−03 | 1.22 |
| 21F06 | 1.80E+07 | 2.20E−03 | 0.12 |
| 23F05 | 3.10E+06 | 3.10E−03 | 0.99 |
| 34A04 | 2.63E+06 | 7.06E−03 | 2.7 |
| 34C07** | 1.80E+04 | 2.50E−04 | 14 |
| Control Fab1 | 7.03E+05 | 3.98E−04 | 0.57 |
| Control Fab2 | 9.34E+04 | 2.59E−04 | 2.77 |

*Heterogenous curve: results of main interaction (89%) presented
**Heterogenous curve: results of main interaction (84%) presented

Example 6
Binding Capacity of Purified Nanobodies to cynoHER3 in ELISA

The binding capacity of the selected purified Nanobodies was determined in ELISA. 96-well plates were coated with cHER3-ECD (1 µg/ml) (SEQ ID NO: 4). A dilution series of each Nanobody starting from 500 nM down to 6 pM was tested and detected using mouse anti c-myc (Roche) and anti-mouse-HRP (Dako cytomation). All Nanobodies bind to cyno HER3-ECD and the obtained EC50 values are shown in Table C-5.

TABLE C-5

EC50 values for various anti-HER3 Nanobodies to cyno HER3-ECD and their 95% confidence intervals as determined by ELISA

|  | EC50 (nM) | CI95 |
|---|---|---|
| 04C07 | 0.93 | 0.5-1.6 |
| 05A09 | 1.3 | 0.83-2.03 |
| 17B05 | 0.66 | 0.4-1.08 |
| 17C08 | 0.59 | 0.39-0.89 |
| 17E08 | 1.15 | 0.65-2.05 |
| 18B05 | 0.45 | 0.26-0.78 |
| 18E08 | 4.4 | 3.4-5.7 |
| 18F05 | 0.29 | 0.16-0.55 |
| 18G11 | 0.64 | 0.36-1.13 |
| 21B02 | 0.9 | 0.6-1.3 |
| 21F06 | 0.32 | 0.15-0.68 |
| 23F05 | 0.44 | 0.26-0.74 |
| 34A04 | 0.49 | 0.31-0.78 |
| 34C07 | 0.43 | 0.24-0.76 |

Example 7
HER3-Specificity of Purified Nanobodies

Off-target binding of purified HER3 Nanobodies was assessed by measuring their binding capacity to Chinese hamster ovary (CHO) cells transfected with human HER1 (SEQ ID NO: 8), human HER2 (SEQ ID NO: 9) or human HER4 (SEQ ID NO: 10) by FACS. Non-transfected cells were used to check binding to the cell background. Purified HER3-specific Nanobodies (2000-666-222 nM) were added to $2\times10^5$ cells, 30 minutes incubated at 4° C. and detected using mouse anti-c-myc (Serotec) and goat anti-mouse-PE (Jackson Immuno-Research Laboratories). Binding of polyclonal antibodies (anti-HER1, R&D Systems AF231; anti-HER2, R&D Systems AF1129; anti-HER4, R&D Systems AF1131) were used as positive control. Low binding levels were observed for Nanobody 21B02 to HER2, whereas the other purified Nanobodies did not bind to HER1, HER2 and HER4 transfected cells (Table C-6).

TABLE C-6

Binding of purified Nanobodies and control polyclonal antibodies to Chinese hamster ovary ovary cells transfected with HER1, HER2 or HER4 as determined by FACS (data represent MCF values).

|  | HER1 | | | HER2 | | | HER4 | | |
|---|---|---|---|---|---|---|---|---|---|
|  | 2000 nM Nb | 667 nM Nb | 222 nM Nb | 2000 nM Nb | 667 nM Nb | 222 nM Nb | 2000 nM Nb | 667 nM Nb | 222 nM Nb |
| 04C07 | 72 | 92 | 75 | 154 | 79 | 84 | 105 | 103 | 96 |
| 17B05 | 49 | 64 | 85 | 134 | 86 | 84 | 116 | 90 | 142 |
| 17C08 | 58 | 47 | 62 | 1218 | 418 | 160 | 254 | 91 | 210 |
| 17E08 | 59 | 52 | 66 | 73 | 51 | 51 | 242 | 117 | 110 |
| 18B05 | 61 | 101 | 82 | 77 | 63 | 61 | 96 | 95 | 60 |
| 18E08 | 64 | 62 | 61 | 78 | 52 | 53 | 115 | 80 | 91 |
| 18F05 | 133 | 60 | 154 | 256 | 347 | 436 | 120 | 149 | 149 |
| 18G11 | 97 | 87 | 101 | 65 | 117 | 109 | 124 | 56 | 57 |
| 19E03 | 91 | 104 | 81 | 167 | 78 | 99 | 140 | 110 | 77 |
| 21B02 | 53 | 64 | 64 | 8574 | 3609 | 1342 | 273 | 119 | 91 |
| 21F06 | 74 | 110 | 107 | 409 | 229 | 84 | 263 | 225 | 149 |
| 23F05 | 67 | 67 | 153 | 832 | 264 | 97 | 95 | 101 | 343 |
| Anti-HER1 pAb (5 µg/ml) | 28217 | | | 888 | | | 418 | | |
| Anti-HER2 pAb (5 µg/ml) | 323 | | | 41048 | | | 578 | | |
| Anti-HER4 pAb (5 µg/ml) | 584 | | | 932 | | | 16981 | | |

Example 8

Epitope Mapping of Purified Nanobody Panel

The classification of Nanobodies in the different epitope bins was an important criterium to select Nanobodies for purification and further characterization (see Examples 2.9 and 3). The FACS competition assay using the biotinylated Nanobodies 04C07 (also denoted as 4C07), 21B02, 23F05, 18E08, 17C08 and 04F10 (also denoted as 4F10) was repeated with three different concentrations of 14 selected purified Nanobodies (400, 100 and 25 nM). The Nanobodies belonging to group 1 and group 2 are very similar but differ in their capacity to compete with Nanobody 04F10 (Table C-7). The Nanobodies of group 3 and group 4 are also very similar but differ in their capacity to compete with 04F10 and 17C08. The Nanobodies classified in one epitope group are considered to bind to identical epitopes, whereas Nanobodies of different epitope groups are considered to bind to partially overlapping (group 1-2 and group 3-4) or non-overlapping epitopes.

TABLE C-7

Epitope competition FACS of 14 selected purified Nanobodies against biotinylated Nanobodies. The data represent the percentage competition at a 400 nM concentration of the non-biotinylated Nanobody.

| Nano-body | 04C07-biotin | 21B02-biotin | 23F05-biotin | 18E08-biotin | 17C08-biotin | 04F10-biotin | Epi-tope group |
|---|---|---|---|---|---|---|---|
| 17B05 | 100 | 0 | 0 | 0 | 0 | 68 | 1 |
| 17E08 | 100 | 5 | 0 | 0 | 0 | 32 | 1 |
| 18B05 | 98 | 0 | 0 | 0 | 0 | 31 | 1 |
| 18F05 | 100 | 0 | 0 | 0 | 0 | 15 | 1 |
| 04C07 | 100 | 2 | 0 | 26 | 15 | 0 | 2 |
| 05A09 | 0 | 22 | 10 | 78 | 48 | 0 | 3 |
| 18E08 | 0 | 4 | 0 | 86 | 63 | 0 | 3 |
| 18G11 | 0 | 0 | 0 | 97 | 74 | 0 | 3 |
| 34C07 | 0 | 6 | 10 | 99 | 56 | 0 | 3 |
| 17C08 | 3 | 16 | 17 | 98 | 97 | 77 | 4 |
| 21B02 | 10 | 100 | 98 | 20 | 17 | 15 | 5 |
| 21F06 | 11 | 100 | 100 | ND | 9 | 15 | 5 |
| 23F05 | 6 | 100 | 100 | 16 | 8 | 15 | 5 |
| 34A04 | 22 | 99 | 97 | 25 | 14 | 3 | 5 |

ND: not determined

To obtain more insight in the epitopes recognized by selected purified Nanobodies, various human-chicken HER3 chimeric proteins were engineered, based on the division of the HER3 extracellular domain into four distinct domains. Plasmids were constructed which encode the transmembrane and extracellular regions of chicken HER3 (based on sequence Genbank accession nr: DQ358720) and variants with individual domains from human HER3 swapped into the chicken scaffold but using the human signal sequence:
  Chicken Her3: AA1-25 human, AA26-642 chicken (SEQ ID NO: 2)
  Chimeric chicken Her3-human domain 1: AA1-206 human, AA207-642 chicken (SEQ ID NO: 5)
  Chimeric chicken Her3-human domain 2: AA1-25 human, AA26-206 chicken, AA207-328 human, AA329-642 chicken (SEQ ID NO: 6)
  Chimeric chicken Her3-human domain 4: AA1-25 human, AA26-495 chicken, AA496-642 human (SEQ ID NO: 7)
The HER3-encoding fragments were synthetically produced and cloned in pcDNA3.1 (Invitrogen). HEK293 (DSMZ) cells were transient transfected with chicken or chimeric HER3 constructs. Surface expression of the constructs was confirmed using a goat anti-hHER3 polyclonal antibody (R&D systems). The Nanobodies were incubated with the transient transfected cells and binding was detected using anti-c-myc and goat anti-mouse-PE. Result of the binding study is shown in FIG. 2. In summary, Nanobodies 17B05, 17E08, 18B05, 18F05 and 04C07 (epitope groups 1 and 2) recognize human domain 1 while Nanobodies 18E08 and 18G11 (epitope group 3) bind to human domain 2. Nanobody 17C08 (epitope group 4) recognizes both domain 1 and domain 2. Three Nanobodies (21B02, 21F06 and 23F05 (epitope group 5)) showed chicken cross-reactivity, hence corresponding epitopes could not be mapped to a specific human HER3 domain.

Domain 1 is involved in ligand binding whereas the dimerization loop involved in HER dimerization is located in domain 2 (Baselga and Swain, 2009 Nature Reviews Cancer Vol 9, p 463-475). Therefore, the mode of action of Nanobodies binding to domain 1 could be related with inhibition of ligand binding and that of Nanobodies binding to domain 2 could be related with blocking HER dimerization

Example 9

HRG1-β1 Competition Capacity of Purified Nanobodies in FACS

The HRG1-β1 competition capacity of purified HER3-specific Nanobodies was determined in a FACS competition experiment using Chinese hamster ovary cells (CHO FlpIn, Invitrogen) transfected with hHER3. A dilution series of each Nanobody starting from 600 nM down to 0.03 nM and 0.8 nM HRG1-β1-EGF (R&D systems, #396-HB) were added to the cells ($2 \times 10^5$) and incubated during 90 minutes at 4° C. After washing the cells with FACS buffer, detection was performed using goat anti-HRG ECD (R&D systems) and donkey anti-goat PE (Jackson ImmunoResearch Laboratories). Nanobodies showed complete competition with HRG1-β1-EGF for HER3 binding, except for Nanobodies 18E08 and 18G11 which did not compete and Nanobody 17C08 which only partially blocked (75%) at a Nanobody concentration of 600 nM. The obtained IC50 values are shown in Table C-8. The lower HRG1-β1 blocking capacity of Nanobodies belonging to epitope group 3 and in lesser extent also group 4 is in agreement with their binding to domain 2 and blocking HER transphosphorylation as mode of action.

TABLE C-8

IC50 values for competition between HRG1-β1-EGF and various anti-HER3 Nanobodies to CHO cells transfected with HER3 and their 95% confidence intervals as determined by FACS.

|  | IC50 (nM) | CI95 |
|---|---|---|
| 04C07 | 4.26 | 3.13-5.81 |
| 17B05 | 33.4 | 29.04-38.40 |
| 17C08 | Partial competition | NA |
| 17E08 | 75.9 | 64.94-88.73 |
| 18B05 | 16.15 | 11.80-22.09 |
| 18E08 | No competition | NA |
| 18F05 | 20.11 | 15.63-25.88 |
| 18G11 | No competition | NA |
| 21B02 | 13.29 | 9.09-19.44 |
| 21F06 | 10.1 | 7.44-13.71 |
| 23F05 | 9.44 | 8.20-10.88 |

TABLE C-8-continued

IC50 values for competition between HRG1-β1-EGF and various anti-HER3 Nanobodies to CHO cells transfected with HER3 and their 95% confidence intervals as determined by FACS.

|  | IC50 (nM) | CI95 |
|---|---|---|
| Control MAb1 | 9.4 | 7.5-11.8 |
| Control MAb2 | 67.2 | 46.4-97.3 |

NA: not applicable.

Example 10

Inhibition of HER3, Akt and ERK1/2 Phosphorylation by purified Nanobodies

To determine the potency of monovalent Nanobodies in inhibiting ligand induced HER3 phosphorylation and downstream signaling, Nanobodies were tested in cell based assays as described below.

Inhibition of ligand induced pHER3 (phosphoHER3) in MCF-7 cells (cell based electrochemiluminescence assay (ECLA)): MCF-7 cells (ATCC HTB 22) were serum starved and pre-incubated with Nanobodies (serial dilutions, starting concentration 666 nM) in serum-free media for 60 min at 37° C., 5% $CO_2$. Cells were stimulated with 50 ng/ml HRG1-β1 EGF domain (R&D Systems, #396-HB) for 10 min, supernatants discarded and cells lysed in cold NP-40 lysis buffer (1% NP-40, 20 mM Tris, pH8.0, 137 mM NaCl, 10% glycerol, 2 mM EDTA, protease inhibitor cocktail set III (Calbiochem), phosphatase inhibitor cocktail set II (Calbiochem)). MA6000 96 well plates (MSD, # L15XB) were blocked with 3% block A (MSD) in PBS, pH7.4, 0.05% Tween20 and coated with HER3 specific capture antibody (R&D Systems, # MAB3481). Cell lysates were added and incubated for 2 h at room temperature (RT). Biotinylated anti-phospho Tyrosine antibody (R&D Systems, # BAM1676) and sulfo tag streptavidin reagent (MSD, #R32AD) were used for detection (Table C-9).

10.1 Inhibition of Downstream Signaling (pAkt/pERK1/2):

MCF-7 cells were pre-incubated with Nanobodies and stimulated as described above. Cell lysates were tested in Phospho-Akt (Ser473) Whole Cell Lysate Kit (MSD, # K151CAD) and Phospho-ERK1/2 Whole Cell Lysate Kit (MSD, # K111DWD) according to manufacturer's instructions (Table C-10).

10.2 Inhibition of EGFR/HER3 and HER2/HER3 Transphosphorylation: MDA MB468 (ATCC HTB 132) and CHO HER2/HER3 cells were serum starved and treated as described above (MDA MB468 stimulation with 50 ng/ml HRG1-β1 EGF domain; CHO HER2/HER3 cells stimulation with 100 ng/ml HRG1-β1 EGF domain). Cell lysates were tested in pHER3 ECLA (Table C-9).

TABLE C-9

Inhibition of HRG1-β1 dependent HER3 phosphorylation by purified Nanobodies

| Nanobody | MCF-7 (IC50 M) | CHO-HER2/HER3 (IC50 M) | MDA-MB468 (IC50 M) |
|---|---|---|---|
| 04C07 | 1.07E−09 | 2.407E−09 | 6.68E−09 |
| 17B05 | 5.34E−09 | 1.18E−09 | 2.79E−08 |
| 18B05 | 5.18E−09 | 3.87E−09 | 3.00E−08 |
| 18F05 | 1.53E−09 | 3.03E−09 | 1.80E−08 |
| 17E08 | 4.51E−09 | 8.01E−10 | 2.46E−08 |
| 18E08 | 6.39E−08 | <50% | 1.01E−07 |
| 18G11 | 1.03E−08 | 2.13E−08 | 7.03E−09 |
| 05A09 | 9.12E−08 | <50% | 1.28E−07 |
| 34C07 | 1.89E−08 | 3.53E−08 | 1.07E−08 |
| 21B02 | 4.88E−08 | <50% | 9.99E−08 |
| 21F06 | 6.789E−09 | 1.447E−08 | 7.94E−09 |
| 23F05 | 1.77E−08 | 7.63E−08 | 2.41E−08 |
| 34A04 | 3.02E−08 | 1.34E−07 | 2.205E−08 |
| 17C08 | 8.98E−08 | <50% | 5.38E−08 |

<50% = less than 50% inhibition

TABLE C-10

Inhibition of HRG1-β1 induced pAKT and pERK1/2

| Nanobody | pAkt ($IC_{50}$ M) | pERK1/2 ($IC_{50}$ M) |
|---|---|---|
| 04C07 | 1.09E−08 | 2.79E−08 |
| 17B05 | 7.83E−09 | 2.36E−09 |
| 18B05 | 6.02E−09 | <50% |
| 18F05 | 8.04E−09 | 8.98E−08 |
| 17E08 | 5.78E−09 | 2.78E−09 |
| 18E08 | 5.69E−08 | <50% |
| 18G11 | 1.38E−07 | <50% |
| 05A09 | 2.898E−07 | <50% |
| 34C07 | 4.99E−08 | 1.00E−07 |
| 21B02 | 6.90E−08 | <50% |
| 21F06 | 2.31E−08 | 1.11E−07 |
| 23F05 | 4.648E−08 | <50% |
| 34A04 | 6.255E−08 | 3.13E−07 |
| 17C08 | 7.24E−07 | <50% |

<50% = less than 50% inhibition

Purified Nanobodies potently inhibited HRG1-131 induced HER3 phosphorylation in MCF-7 cells, and cells expressing EGFR/HER3 (MDA MB468) or HER2/HER3 respectively (CHO HER2/HER3) with the exceptions of 18E08, 05A09, 21B02, and 17C08 which showed less than 50% inhibition of pHER3 in CHO HER2/HER3 cells. PI3Kinase pathway (pAkt) inhibition could be detected with all Nanobodies. To a lesser extent downstream signaling through pERK1/2 could be blocked by Nanobodies.

The data described in Examples 9 and 10 suggest that Nanobodies of group 3 block transphosphorylation of HER3 without blocking ligand binding.

Example 11

Migration Blocking Capacity of Purified Nanobodies

The ability of Nanobodies to inhibit HRG1-β1 dependent cell migration was assessed in the following assay. A431 cells (CRL 1555) were seeded in HTS Fluoroblok 96 well plate inserts (BD Falcon #351164) in the presence of Nanobodies (serial dilutions; starting at 666 nM). Media plus 500 nM HRG1-β1 extracellular domain (R&D Systems, #377-HB) was added to the bottom wells. Migrated cells were stained with CalceinAM and fluorescence detected by plate reader. Nanobodies inhibiting ligand dependent cancer cell migration could be identified (Table C-11).

TABLE C-11

Inhibition of HRG1-β1 induced cell migration

| Nanobody | IC$_{50}$ M |
|---|---|
| 04C07 | 6.52E−09 |
| 17B05 | 3.04E−09 |
| 18B05 | <50% |
| 18F05 | 1.52E−07 |
| 17E08 | 5.76E−08 |
| 18E08 | <50% |
| 21B02 | <50% |
| 21F06 | 4.00E−08 |
| 23F05 | 3.68E−07 |
| 04F10 | no effect |
| 17C08 | no effect |
| 18G11 | 6.79E−08 |
| 34C07 | 1.37E−07 |

<50% = less than 50% inhibition

Example 12

Generation of Formatted Nanobodies

The structural requirement for multi-specificity is to fuse two or more binding domains together, with sufficient flexibility to allow simultaneous binding to different target epitopes and/or combine binding domains with a different mode of action (blocking ligand binding and blocking HER dimerization) in one molecule.

Nanobodies binding to different epitopes were combined in one molecule and fused to an anti-albumin binding Nanobody to increase the half-life of the molecule. GS-linkers were inserted between the Nanobody building blocks. Binding of the two HER3-specific Nanobody building blocks simultaneously without a significant loss of entropy increased binding affinity to the target, resulting in higher potency and/or higher specificity. Careful selection of the epitopes targeted on the antigen and optimal design of linkers to allow maximal flexibility of the binding domains resulted in the blocking of two or more critical sites of the target. The amino acid sequences of selected formatted Nanobody constructs are shown in Table A-2.

Example 13

Analysis of the HER1-HER3 Heterodimerization Blocking Capacity of Monovalent Nanobody 17B05

To determine the potency of monovalent Nanobodies in inhibiting EGFR ligand induced HER3 phosphorylation Nanobodies were tested in cell based assays as described below.

Inhibition of EGFR ligand induced pHER3 (phospho-HER3) in CHO EGFR/Her3 cells (cell based electrochemiluminescence assay (ECLA)): CHO EGFR/Her3 were serum starved and pre-incubated with Nanobodies or EGFR antibody cetuximab (serial dilutions, starting concentration 666 nM or 167 nM) in serum-free media for 60 min at 37° C., 5% CO$_2$. Cells were stimulated with 100 ng/ml rhTGFα (R&D Systems, #239-A), EGF (Sigma#E-9644), or rh epiregulin (R&D Systems, #1195EP) respectively for 10 min, supernatants discarded and cells lysed in cold NP-40 lysis buffer (1% NP-40, 20 mM Tris, pH8.0, 137 mM NaCl, 10% glycerole, 2 mM EDTA, protease inhibitor cocktail set III (Calbiochem), phosphatase inhibitor cocktail set II (Calbiochem)). MA6000 96 well plates (MSD, # L15XB) were blocked with 3% block A (MSD) in PBS, pH7.4, 0.05% Tween20 and coated with HER3 specific capture antibody (R&D Systems, # MAB3481). Cell lysates were added and incubated for 2 h at room temperature (RT). Biotinylated anti-phospho Tyrosine antibody (R&D Systems, # BAM1676) and sulfo tag streptavidin reagent (MSD, #R32AD) were used for detection (Table C-12). Monovalent Nanobody 17B05 was able to potently block EGFR ligand induced HER3 phosphorylation, whereas domain II binders 18G11 and 34C07 were not able to block EGFR ligand induced HER3 phosphorylation.

TABLE C-12

Inhibition of EGFR ligand induced HER3 phosphorylation

| Nanobody/antibody | CHO EGFR/HER3 + TGFα (IC50 M) | CHO EGFR/HER3 + EGF (IC50 M) | CHO EGFR/HER3 + epiregulin (IC50 M) |
|---|---|---|---|
| cetuximab | 1.09e−009 | 1.29e−009 | 6.35e−010 |
| 18G11 | no effect | no effect | no effect |
| 34C07 | no effect | no effect | no effect |
| 17B05 | 8.15e−010 | 3.43e−010 | 2.48e−010 |
| control Mab-1 | no effect | no effect | <50% |
| control Mab-2 | no effect | no effect | 2.36e−007 |

<50% = less than 50% inhibition

Example 14

Generation of Multivalent Parental HER3-Specific Nanobodies with Half-Life Extension (HLE)

In order to generate a half-life extended Nanobody product that blocks HRG binding to HER3 and also blocks heterodimerization of HER3, the monovalent lead panel Nanobodies (4C07, 17C08, 18G11, 21F06, 34C07 and 17B05) were formatted to bivalent and multivalent molecules.

For half-life extension, it was opted to fuse the constructs to the anti-HSA Nanobody ALB11.A library approach was used to make all possible Nanobody1-35GS-Nanobody2-9GS-ALB11 combinations. The multivalent Nanobodies were expressed as c-myc, His6-tagged protein in *Pichia pastoris*. Induction of Nanobody expression occurred by stepwise addition of methanol. Clarified medium with secreted Nanobody was used as starting material for immobilized metal affinity chromatography (IMAC) followed by desalting resulting in at least 90% purity as assessed by SDS-PAGE. The purified multivalent parental HER3-specific Nanobodies were tested in a HRG-blocking alphascreen using 20 nM HRG and 0.05 nM HER3-Fc. The results indicated that the best Nanobody building block determined the potency of the formatted Nanobodies (Table C-13). Nanobody 21F06 was the most potent monovalent building block in this assay (IC50 1.35E−11 M) and all constructs containing 21F06 as building block have IC50s between 5.69E−12 M and 5.77E−11 M.

TABLE C-13

HRG competition alphascreen results of multivalent parental anti-HER3 Nanobodies

| construct | Nb1 | linker | Nb2 | linker | ALB11 | IC50 (M) | CI95 (M) | % inhibition |
|---|---|---|---|---|---|---|---|---|
| HER3MS00022 | 21F06 | 35GS | 21F06 | 9GS | ALB11 | 5.69E-12 | [4E-12, 8E-12] | 103% |
| HER3MS00024 | 21F06 | 35GS | 4C07 | 9GS | ALB11 | 8.98E-12 | [6E-12, 13E-12] | 104% |
| HER3MS00034 | 21F06 | 35GS | 18G11 | 9GS | ALB11 | 1.06E-11 | [0.8E-11, 1.3E-11] | 99.40% |
| HER3MS21F06 | 21F06 | | | | | 1.35E-11 | [0.5E-11, 2.9E-11] | 103.7% |
| HER3MS00060 | 21F06 | 35GS | 17B05 | 9GS | ALB11 | 1.2E-11 | [9.4E-12, 1.4E-11] | 108% |
| HER3MS00023 | 21F06 | 35GS | 34C07 | 9GS | ALB11 | 1.57E-11 | [1.3E-11, 1.9E-11] | 102% |
| HER3MS00030 | 4C07 | 35GS | 21F06 | 9GS | ALB11 | 1.58E-11 | [1.4E-11, 1.8E-11] | 101.70% |
| HER3MS00037 | 18G11 | 35GS | 18G11 | 9GS | ALB11 | 1.59E-11 | [1.2E-11, 2.1E-11] | 107% |
| HER3MS00061 | 17B05 | 35GS | 21F06 | 9GS | ALB11 | 2.5E-11 | [1.9E-11, 3.1-11] | 108% |
| HER3MS00026 | 34C07 | 35GS | 21F06 | 9GS | ALB11 | 5.77E-11 | [4.4E-11, 7.6E-11] | 104% |
| HER3MS00055 | 4C07 | 35GS | 17B05 | 9GS | ALB11 | 1.2E-10 | [8.9E-11, 1.5E-10] | 87% |
| HER3MS00032 | 4C07 | 35GS | 4C07 | 9GS | ALB11 | 1.32E-10 | [1.14E-10, 1.52E-10] | 86.60% |
| HER3MS00035 | 4C07 | 35GS | 18G11 | 9GS | ALB11 | 1.34E-10 | [1.08E-11, 1.67E-11] | 90.40% |
| HER3MS00031 | 4C07 | 35GS | 34C07 | 9GS | ALB11 | 1.57E-10 | [1.15E-10, 2.14E-10] | 87.40% |
| HER3MS00039 | 18G11 | 35GS | 4C07 | 9GS | ALB11 | 2.14E-10 | [1.72E-10, 2.68E-10] | 90.70% |
| HER3MS00057 | 17B05 | 35GS | 4C07 | 9GS | ALB11 | 2.2E-10 | [1.7E-10, 2.9E-10] | 88% |
| HER3MS04C07 | 4C07 | | | | | 2.64E-10 | [2.6E-10, 3.2E-10] | 86.70% |
| HER3MS00056 | 17B05 | 35GS | 17B05 | 9GS | ALB11 | 3.1E-10 | [2.3E-10, 4.2E-10] | 88% |
| HER3MS00054 | 17B05 | 35GS | 34C07 | 9GS | ALB11 | 3.2E-10 | [2.8E-10, 3.6E-10] | 89% |
| HER3MS00028 | 34C07 | 35GS | 4C07 | 9GS | ALB11 | 3.27E-10 | [2.4E-10, 4.5E-10] | 88.60% |
| HER3MS00058 | 17B05 | 35GS | 18G11 | 9GS | ALB11 | 4.2E-10 | [3.4E-10, 5.2E-10] | 96% |
| HER3MS00051 | 34C07 | 35GS | 17B05 | 9GS | ALB11 | 4.6E-10 | [3.6E-10, 5.7E-10] | 95% |
| HER3MS00038 | 18G11 | 35GS | 21F06 | 9GS | ALB11 | 4.76E-10 | [3.51E-10, 6.46E-10] | 96% |
| HER3MS17B05 | 17B05 | | | | | 7.55E-10 | [4.5E-10, 8.1E-10] | 87% |
| HER3MS00052 | 18G11 | 35GS | 17B05 | 9GS | ALB11 | 7.6E-10 | [6.6E-10, 8.8E-10] | 97% |
| HER3MS34C07 | 34C07 | | | | | 8.15E-10 | [2.16E-10, 9.8E-10] | 65.20% |
| HER3MS18G11 | 18G11 | | | | | no comp | NA | no comp |

Example 15

Analysis of the HRG Induced Signaling Blocking Capacity of the Multivalent Parental Nanobodies with ALB11 HLE in Cellular Assays To determine the potency of multivalent Nanobodies in inhibiting ligand induced HER3 phosphorylation and EGFR/Her3 and Her2/Her3 transphosphorylation, Nanobodies were tested in cell based assays as described below. Inhibition of ligand induced pHER3 (phosphoHER3) in MCF-7 cells (cell based electrochemiluminescence assay (ECLA)): MCF-7 cells (ATCC HTB 22) were serum starved and pre-incubated with Nanobodies (serial dilutions, starting concentration 666 nM or 167 nM) in serum-free media for 60 min at 37° C., 5% CO2. Cells were stimulated with 50 ng/ml HRG1-β1 EGF domain (R&D Systems, #396-HB) for 10 min, supernatants discarded and cells lysed in cold NP-40 lysis buffer (1% NP-40, 20 mM Tris, pH8.0, 137 mM NaCl, 10% glycerol, 2 mM EDTA, protease inhibitor cocktail set III (Calbiochem), phosphatase inhibitor cocktail set II (Calbiochem)). MA6000 96 well plates (MSD, # L15XB) were blocked with 3% block A (MSD) in PBS, pH7.4, 0.05% Tween20 and coated with HER3 specific capture antibody (R&D Systems, # MAB3481). Cell lysates were added and incubated for 2 h at room temperature (RT). Biotinylated anti-phospho Tyrosine antibody (R&D Systems, # BAM1676) and sulfo tag streptavidin reagent (MSD, #R32AD) were used for detection (Table C-14). Inhibition of EGFR/HER3 and HER2/HER3 transphosphorylation: MDA MB468 (ATCC HTB 132) and CHO HER2/HER3 cells were serum starved and treated as described above (MDA MB468 stimulation with 50 ng/ml HRG 1-β1 EGF domain; CHO HER2/HER3 cells stimulation with 100 ng/ml HRG1-β1 EGF domain). Cell lysates were tested in pHER3 ECLA (Table C-14).

Multivalent parental Nanobodies with Alb11 potently inhibited HRG1-β1 induced HER3 signaling in MCF-7 cells, as well as cells expressing HER2/HER3 (CHO HER2/HER3) and cells expressing EGFR/HER3 (MDA-MB468).

TABLE C-14

Inhibition of HRG induced HER3 phosphorylation by multivalent parental Nanobodies with Alb11 HLE

| construct | Nb1 | linker | Nb2 | linker | ALB11 | MCF-7, HRG1-β1 IC50 (M) | CHO HER2/HER3, HRG1-β1 IC50 (M) | MDA468, HRG1-β1 IC50 (M) |
|---|---|---|---|---|---|---|---|---|
| HER3MS00022 | 21F06 | 35GS | 21F06 | 9GS | ALB11 | 5.90E-11 | 1.84E-09 | 1.54E-10 |
| HER3MS00023 | 21F06 | 35GS | 34C07 | 9GS | ALB11 | 1.82E-10 | 7.06E-10 | 1.51E-11 |
| HER3MS00026 | 34C07 | 35GS | 21F06 | 9GS | ALB11 | 8.856E-10 | 2.163E-09 | 2.367E-10 |
| HER3MS00028 | 34C07 | 35GS | 4C07 | 9GS | ALB11 | 2.24E-09 | 2.06E-09 | 5.39E-10 |
| HER3MS00030 | 4C07 | 35GS | 21F06 | 9GS | ALB11 | 3.18E-10 | 4.50E-09 | 4.69E-10 |
| HER3MS00032 | 4C07 | 35GS | 4C07 | 9GS | ALB11 | 4.89E-10 | 4.78E-10 | 1.04E-10 |
| HER3MS00034 | 21F06 | 35GS | 18G11 | 9GS | ALB11 | 7.24E-10 | 1.29E-08 | 9.80E-10 |
| HER3MS00035 | 4C07 | 35GS | 18G11 | 9GS | ALB11 | 4.16E-10 | 6.88E-10 | 8.61E-11 |
| HER3MS00037 | 18G11 | 35GS | 18G11 | 9GS | ALB11 | 7.29E-09 | 5.95E-09 | 1.15E-09 |
| HER3MS00038 | 18G11 | 35GS | 21F06 | 9GS | ALB11 | 2.62E-10 | 3.63E-09 | 4.65E-10 |
| HER3MS00039 | 18G11 | 35GS | 4C07 | 9GS | ALB11 | 2.26E-09 | 2.40E-09 | 1.96E-10 |
| PHER3MS00051 | 34C07 | 35GS | 17B05 | 9GS | ALB11 | 1.401E-08 | n.d. | n.d. |

TABLE C-14-continued

Inhibition of HRG induced HER3 phosphorylation by multivalent parental Nanobodies with Alb11 HLE

| construct | Nb1 | linker | Nb2 | linker | ALB11 | MCF-7, HRG1-β1 IC50 (M) | CHO HER2/HER3, HRG1-β1 IC50 (M) | MDA468, HRG1-β1 IC50 (M) |
|---|---|---|---|---|---|---|---|---|
| PHER3MS00052 | 18G11 | 35GS | 17B05 | 9GS | ALB11 | 7.446E−09 | n.d. | n.d. |
| PHER3MS00054 | 17B05 | 35GS | 34C07 | 9GS | ALB11 | 2.673E−09 | n.d. | n.d. |
| PHER3MS00055 | 4C07 | 35GS | 17B05 | 9GS | ALB11 | 2.69E−09 | n.d. | n.d. |
| PHER3MS00056 | 17B05 | 35GS | 17B05 | 9GS | ALB11 | 2.579E−09 | n.d. | n.d. |
| PHER3MS00057 | 17B05 | 35GS | 4C07 | 9GS | ALB11 | 2.01E−09 | n.d. | n.d. |
| PHER3MS00058 | 17B05 | 35GS | 18G11 | 9GS | ALB11 | 4.434E−09 | n.d. | n.d. |
| PHER3MS00060 | 21F06 | 35GS | 17B05 | 9GS | ALB11 | 1.513E−09 | n.d. | n.d. |
| PHER3MS00061 | 17B05 | 35GS | 21F06 | 9GS | ALB11 | 3.041E−09 | n.d. | n.d. |
| PHER3MS00062 | 18G11 | 35GS | 3407 | 9GS | ALB11 | 1.124E−08 | n.d. | n.d. |
| PHER3MS00063 | 34C07 | 35GS | 18G11 | 9GS | ALB11 | 1.225E−08 | n.d. | n.d. |
| HER3MS00110 | 21F06 | 9GS | ALB11 | 9GS | 17B05 | 1.569E−09 | n.d. | n.d. |
| HER3MS00111 | 17B05 | 9GS | ALB11 | 9GS | 17B05 | 1.523E−09 | n.d. | n.d. |
| HER3MS00112 | 21F06 | 9GS | ALB11 | 9GS | 18G11 | 3.24E−10 | n.d. | n.d. |
| HER3MS00113 | 18G11 | 9GS | ALB11 | 9GS | 21F06 | 8.608E−10 | n.d. | n.d. |
| HER3MS00114 | 17B05 | 9GS | ALB11 | 9GS | 4C07 | 2.994E−09 | n.d. | n.d. |
| HER3MS00115 | 4C07 | 9GS | ALB11 | 9GS | 17B05 | 1.939E−09 | n.d. | n.d. |
| HER3MS00116 | 21F06 | 35GS | ALB11 | 35GS | 17B05 | 6.238E−10 | n.d. | n.d. |
| HER3MS00117 | 21F06 | 35GS | ALB11 | 35GS | 18G11 | 6.667E−10 | n.d. | n.d. | n.d. = not determined

Example 16

Analysis of the EGFR-HER3 Heterodimerization Blocking Capacity of the Multivalent Parental Nanobodies with ALB11 HLE in Cellular Assays Multivalent parental Nanobodies containing 17B05 as one building block, Alb11, and a second HER3 Nanobody (04C07, 18G11, 21F06, 34C07, or 17B05) were tested for their ability to block EGFR ligand induced Her3 phosphorylation. All 17B08 containing multivalent parental Nanobodies potently blocked TGFα induced pHER3 in CHO EGFR/HER3 cells as demonstrated for monovalent 17B05.

CHO EGFR/HER3 cells were serum starved and pre-incubated with Nanobodies or EGFR antibody cetuximab (serial dilutions, starting concentration 166.7 nM) in serum-free media for 60 min at 37° C., 5% $CO_2$. Cells were stimulated with 100 ng/ml rhTGFα (R&D Systems, #239-A) for 10 min, supernatants discarded and cells lysed in cold NP-40 lysis buffer (1% NP-40, 20 mM Tris, pH8.0, 137 mM NaCl, 10% glycerol, 2 mM EDTA, protease inhibitor cocktail set III (Calbiochem), phosphatase inhibitor cocktail set II (Calbiochem)). MA6000 96 well plates (MSD, # L15XB) were blocked with 3% block A (MSD) in PBS, pH7.4, 0.05% Tween20 and coated with HER3 specific capture antibody (R&D Systems, # MAB3481). Cell lysates were added and incubated for 2 h at room temperature (RT). Biotinylated anti-phospho Tyrosine antibody (R&D Systems, # BAM1676) and sulfo tag streptavidin reagent (MSD, #R32AD) were used for detection (Table C-15).

TABLE C-15

Inhibition of TGFα induced HER3 phosphorylation by multivalent parental Nanobodies with Alb11 HLE and 17B05

| construct | Nb1 | linker | Nb2 | linker | ALB11 | CHO EGFR/HER3, TGFα IC50 (M) |
|---|---|---|---|---|---|---|
| PHER3MS00051 | 34C07 | 35GS | 17B05 | 9GS | ALB11 | $3.967^E$−09 |
| PHER3MS00052 | 18G11 | 35GS | 17B05 | 9GS | ALB11 | $5.624^E$−09 |
| PHER3MS00054 | 17B05 | 35GS | 34C07 | 9GS | ALB11 | $2.316^E$−09 |
| PHER3MS00055 | 4C07 | 35GS | 17B05 | 9GS | ALB11 | $7.899^E$−09 |
| PHER3MS00056 | 17B05 | 35GS | 17B05 | 9GS | ALB11 | $1.459^E$−09 |
| PHER3MS00057 | 17B05 | 35GS | 4C07 | 9GS | ALB11 | $6.416^E$−09 |
| PHER3MS00058 | 17B05 | 35GS | 18G11 | 9GS | ALB11 | $5.782^E$−09 |
| PHER3MS00060 | 21F06 | 35GS | 17B05 | 9GS | ALB11 | $1.08^E$−09 |
| PHER3MS00061 | 17B05 | 35GS | 21F06 | 9GS | ALB11 | $2.586^E$−09 |
| HER3MS00110 | 21F06 | 9GS | ALB11 | 9GS | 17B05 | $1.41^E$−09 |
| HER3MS00111 | 17B05 | 9GS | ALB11 | 9GS | 21F06 | $1.61^E$−09 |
| HER3MS00114 | 17B05 | 9GS | ALB11 | 9GS | 04C07 | $3.332^E$−09 |
| HER3MS00115 | 4C07 | 9GS | ALB11 | 9GS | 17B05 | $8.373^E$−09 |
| HER3MS00116 | 21F06 | 35GS | ALB11 | 35GS | 17B05 | $1.772^E$−09 |
| control Mab-1 | | | | | | <50% |

<50% = less than 50% inhibition

Example 17

Induction of HER3 Internalization by the Multivalent Parental Nanobodies with ALB11 HLE The effect of HER3-specific Nanobodies on HER3 internalization was assessed using MCF-7 and MALME-3M cells. Cells were seeded in 6 well plates at a concentration of $10^5$ cells/ml and incubated in a cell incubator at 37° C. for 2 days. Then, 100 nM Nanobody was added with or without 5 μM HSA (Sigma, A8763) and cells were 2 h incubated at 4° C. or 37° C. Wells with control MAb1 and wells without any Nanobody or MAb were taken along as positive and negative controls respectively. After washing the cells, they were harvested and stained with anti-HER3 (R&D systems, #AF234) and donkey anti-goat-PE (Jackson ImmunoResearch Laboratories). The samples were measured using a FACS Array (Becton Dickinson) and the percentage internalization was determined by comparing the obtained signal of HER3 surface expression in 37° C. conditions with that in the negative control condition at 4° C. None of the monovalent Nanobodies was able to induce HER3 internalization, whereas bivalent 17B05 induced 17.8% internalization. Bivalent 18G11, 34C07, 4C07 and 21F06 induced 60-70% internalization, which is slightly higher than the positive control MAb1 (57% internalization). Induction of HER3 internalization by biparatopic constructs was dependent on their respective compositions. No internalization was observed when 21F06 was present in the construct. In constructs without 21F06, internalization (40-70%) was only observed when 17B05 or 04C07 was located at the N-terminal position. Identical results were obtained in both cell lines.

Example 18

Sequence Optimization

Nanobodies 4C07, 17B05, 21F06, 18G11 and 34C07 were taken further for sequence optimization. This is a process in which parental Nanobody sequences are mutated to yield Nanobody sequences that are more identical to human VH3-JH germline consensus sequences. Specific amino acids, with the exception of the so-called hallmark residues, in the FRs that differ between the Nanobody and the human VH3-JH germline consensus are altered in the human counterpart in such a way that the protein structure, activity and stability are kept intact. The parental Nanobody amino acid sequence is also aligned to the llama IGHV germline amino acid sequence of the Nanobody (identified as the top hit from a BlastP analysis of the Nanobody against the llama IGHV germlines), and in certain cases mutations towards the llama germline are introduced to increase the stability of the Nanobody, which is defined as llamanisation. In addition potential sites for Post Translational Modifications (PTMs as deamidation, isomerisation, methionine oxidation) are changed to guarantee chemical stability. The analysis occurred in two rounds, in a first round single mutations and combined mutations upon the basic variants were evaluated. Based upon these results, acceptable substitutions are combined in second round variants which are further characterized.

Six amino acid residues in 04C07 can be substituted for humanization purposes. In the sequence optimization process, four 04C07 versions (a basic version and 3 additional variants) were constructed. The basic variant (HER3MS0042) contains 4 substitutions: A14P, A74S, K83R and Q108L. In addition to these changes, the A46E and L93A substitutions were introduced and investigated in additional variants. The constructs were expressed in *E. coli* and purified by IMAC and desalting.

The purified molecules were evaluated for their HRG blocking capacity using alphascreen. Also thermal stability of the variants was tested in a thermal shift assay using the Lightcycler (Roche). In this assay the Nanobody variants are incubated at different pH's in the presence of sypro orange and a temperature gradient is applied. When the Nanobodies start denaturating, sypro orange binds and the measured fluorescence increases suddenly. A melting temperature can be determined for a certain pH. Results are summarized in C-16.

TABLE C-16 results of the first round sequence optimization variants of 04C07

| ID | Mutation(s) | IC50 HRG competition alphascreen (M) | Tm at pH 7 (° C.) |
|---|---|---|---|
| HER3MS04C07 | parental | 2.7E−10−6.9E−10 | 58.55 |
| HER3MS0042 (basic) | A14P, A74S, K83R, Q108L | 3.1E−10 | 60.3 |
| HER3MS0043 | basic + A46E | 1.02E−9 | 66.5 |
| HER3MS0044 | basic + L93A | 1.00E−9 | 62 |
| HER3MS0045 | basic + A46E + L93A | 4.91E−9 | 66.9 |

The basic variant had a similar potency in the HRG blocking alphascreen as the parental 04C07 Nanobody, meaning that the mutations on positions 14, 74, 84 and 108 were accepted. A 3- to 4-fold lower potency was observed in variants HER3MS0043 (A46E) and HER3MS0044 (L93A), which increases to a 18-fold potency drop if they were combined. All variants had a positive influence on stability as higher Tm values were obtained than for the parental 04C07 Nanobody. Analysis of post translational modification sites indicated deamidation at position N101 (22-29% deamidation after 4 weeks storage at 40° C. and 9-14% deamidation after 3 days storage at pH9 and 25° C.). A library of N101X was made, transfected in *E. coli* and Nanobody containing periplasmic lysates were tested for their HRG blocking capacity in a competition FMAT as well as for their off rate on recombinant HER3. All tested variants gave 99-100% blocking and a 2-3 fold higher off rate compared to the parental 04C07 Nanobody. The variants N101G and N101S were selected for further characterization. Pyroglutamate formation was 6.6% after 4 weeks storage at 40° C., which was acceptable and did not require an amino acid substitution at position 1. Four variants were made in the second round sequence optimization. They were combinations of the basic variant with substitutions A46E, N101G or N101S (Table C-17). Introduction of the substitution A46E resulted in a significant potency drop in the HRG competition alphascreen and pHER3 blocking assay in MCF7 cells but on the other hand increased stability as a Tm increase of 4.5° C. was observed. These results were in agreement with first round sequence optimization results. Mutation of N101 to G or S gave a 5- to 6-fold potency drop and a decrease in Tm of 1.5-2° C. Variants HER3MS00129 and HER3MS00130 were selected for further characterization as formatting could mask their lower potency in a monovalent format. The percentage framework identity in the framework region for HER3MS00129 is 95.5% and for HER3MS00130 94.4%, based on the AbM definition.

TABLE C-17 results of the second round sequence
optimization variants of 04C07

| ID | Mutations | IC50 HRG competition alphascreen (M) | IC50 pHER3 HRG1-β1 stimulated MCF7 (M) | TM pH 7 (° C.) |
|---|---|---|---|---|
| HER3MS04C07 | parental | 1.8E-10 | 6.25E-09 | 58.55 |
| HER3MS0042 (basic) | A14P, A74S, K83R, Q108L | 3.1E-10 | 6.805E-9 | 60.3 |
| HER3MS00129 | basic + A46E + N101G | 5.1E-9 | 1.21E-07 | 63.1 |
| HER3MS00130 | basic + N101G | 8.8E-10 | 9.38E-09 | 56.5 |
| HER3MS00131 | basic + A46E + N101S | 5.8E-9 | 2.26E-07 | 63.5 |
| HER3MS00132 | basic + N101S | 1.0E-9 | 1.31E-08 | 56.9 |

Five amino acid residues in 21F06 can be substituted for humanization/llamanization purposes and five amino acid substitutions can be analysed for chemical stability purposes. In the sequence optimization process, four 21F06 versions (a basic version and 3 additional variants) were constructed. The basic variant (HER3MS0046) contains 4 substitutions: A14P, A74S, K83R and Q108L. In addition to these changes, the G40A and D44E substitutions were introduced and investigated in additional variants. The constructs were expressed in *E. coli* and purified by IMAC and desalting. The purified molecules were evaluated for their HRG blocking capacity using alphascreen. Also thermal stability of the variants was tested in a thermal shift assay using sypro orange and applying a temperature gradient. When the Nanobodies start denaturating, sypro orange binds and the measured fluorescence increases suddenly. A melting temperature can be determined for a certain pH. Results are summarized in Table C-18.

TABLE C-18

Results of 21F06 humanization variants in
the first round sequence optimization

| ID | Mutations | IC50 HRG competition alphascreen (M) | IC50 pHER3 HRG1-β1 stimulated MCF7 (M) | Tm at pH 7 (° C.) |
|---|---|---|---|---|
| HER3MS21F06 | parental | 2.5E-10 | 8.74E-9 | 67.3 |
| HER3MS0046 basic | A14P, A74S, K83R, Q108L | 2.8E-10 | NA | 67.4 |
| HER3MS0047 | basic + G40A | 2.1E-10 | NA | 71.1 |
| HER3MS0048 | basic + D44E | 2.7E-10 | NA | 67.8 |
| HER3MS0049 | basic + G40A + D44E | 2.5E-10 | 2.79E-9 | 70.6 |

All tested variants had a similar potency in the HRG blocking alphascreen as the parental 21F06 Nanobody, meaning that the mutations on positions 14, 40, 44, 74, 84 and 108 were accepted. The G40A substitution resulted in an increased Tm value, suggesting that it had a positive effect on the stability of the Nanbody. To deal with 2 potential isomerisation sites and one Met oxidation site, libraries were made where the amino acids D54, G55, M100b, D101 and S102 were randomized. The libraries were transformed in TG1 and individual colonies were picked and grown in 96-well plates. Periplasmic extracts were prepared, sequenced and screened. All tested variants as well as 21F06 parental gave complete block in a HRG competition FMAT experiment and off rate analysis also could not discriminate between these variants and 21F06 parental (6.2E-4-8.3E-4).

Some variants were selected (based on similar characteristics of original and substituted amino acid) to purify and test for their thermal stability. Results are shown in C-19.

TABLE C-19

Tm results of 21F06 chemical stability variants
in the first round sequence optimization

| ID | Mutations | Tm at pH 7 (° C.) |
|---|---|---|
| HER3MS21F06 | Parental (P) | 64 |
| HER3MS00088 | P + D54Y – Q108L | 60.7/61.06 |
| HER3MS00089 | P + D54E – Q108L | 61.1/61.9 |
| HER3MS00090 | P + G55A – Q108L | 54.8 |
| HER3MS00091 | P + M100bF – Q108L | 56.1/56.8 |
| HER3MS00092 | P + M100bY – Q108L | 56.9/57.3 |
| HER3MS00093 | P + M100bL – Q108L | 60.7 |
| HER3MS00094 | P + D101Q – Q108L | 62.3 |
| HER3MS00095 | P + D101E – Q108L | 60.3/60.7 |
| HER3MS00096 | P + S102D – Q108L | 50.3 |
| HER3MS00097 | P + S102E – Q108L | 55.7 |
| HER3MS00098 | P + S102T – Q108L | 65.2 |

Analysis of post translational modification sites indicated 14% pyroglutamate after 4 weeks storage at 40° C. and no substitution was introduced at position 1. Thirteen percent of the mono-oxidized material was observed after 3 h treatment with 10 mM $H_2O_2$ at room temperature. Substitution of M100b was required and mutation M100bL was selected based on screening data and physical similarity between M and L. Storage of parental 21F06 under forced deamidation conditions (4 weeks at 40° C. or 3 days at pH9 and 25° C.) induced 20% deamidation at position N73. However, the percentage deamidation was only 3.2 after 3 weeks storage at 25° C. Analysis of a 21F06 variant containing the basic mutation A74S showed a slightly higher percentage of deamidation: 37.1% after storage in forced deamidation conditions (3 days at pH9 and 25° C.) and 4.9% after 3 weeks storage at 25° C. It was concluded to keep A74S for further characterization in a second round of sequence optimization as this increased the percentage of framework identity compared to human antibodies and deamidation could be kept under control during DSP/USP since only a deamidated fraction of <5% was observed in the 25° C. conditions. Finally, 12.9% deamidation was observed of D54 and mutation D54E was selected based on screening data and physical similarity between D and E.

The second round 21F06 sequence optimization variant HER3MS00122 was made which combined the substitutions A14P, G40A, D44E, A74S, K83R and Q108L. This variant and parental 21F06 gave a similar IC50 in a HRG alphascreen competition assay as well as in the pHER3 blocking assay using MCF7 cells and showed an identical Tm value. 21F06 variant HER3MS00122 has 91% framework identity in the framework region according to the AbM definition.

Based on these results, HER3MS00122 was selected as the final sequence optimized 21F06 Nanobody.

Five amino acid residues in 18G11 can be substituted for humanization purposes and four amino acid substitutions can be analysed for chemical stability purposes. In this case the basic variant was made, containing mutations $K_{83}R$ and Q108L. Then, a mini-library of the basic variant with $2^6$=64 permutations at positions 44, 61, 64, 74, 75 and 77 was constructed. Mutation H93A was not investigated since this mutation is close to CDR3 which increased the chance that humanization would affect the potency of the Nanobody.

The libraries were transformed in TG1 and individual colonies were picked and grown in 96 well plates. Periplasmic extracts were prepared, sequenced and screened for competition with biotinylated parental 18G11 to bind recombinant HER3-Fc. The parental 18G11 Nanobody and its basic variant HER3MS0050 showed identical potency in alphascreen (IC50 3.2E-9 M) and an identical Tm of 72° C. The substitution W75K was not tolerated as a total loss in HER3 binding was observed. Thirty three unique competitors were tested for off rate on recombinant HER3-ECD. Most clones were within a 2-fold higher $k_d$ range compared to parental 18G11 ($k_d$ 6.2-7.7E-4 s$^{-1}$), only three variants showed a 2-3 fold higher off rate. The results suggested that substitutions E64K, T74S, A77T, K83R, Q108L had no effect on the potency or stability of 18G11, whereas a 28% reduction in potency was observed in presence of substitution R44Q. However, the R44Q substitution increased the Tm values with around 4° C. suggesting that the stability of the molecules improved.

Analysis of post translational modification sites revealed 12.3% pyroglutamate formation at position 1 after 4 weeks storage at 40° C. but this level did not require substitution of E1. No isomerization variants at position 95 could be detected after 4 weeks storage at 40° C. and significant oxidation was only observed at amino acids M99 and M102 (30-40% mono-oxidized variant after forced oxidation using 10 mM $H_2O_2$ during 3 h at room temperature). Two substitution libraries were made to deal with these Met oxidation sites (M99X and M102X). The libraries were transformed in TG1 and individual colonies were picked and grown in 96 well plates. Periplasmic extracts were prepared, sequenced and screened for competition with biotinylated parental 18G11 to bind recombinant HER3-Fc. Subsequently, 18 unique competitors were tested in off rate screening on recombinant HER3-ECD. Sixteen clones showed identical $k_d$ values as parental 18G11 (6.10E-4 s−1). Seven variants were selected for purification and further characterization for their capacity to block pHER3 signaling in MCF7 cells and their stability using the thermal shift assay. The results are shown in Table C-20. The substitutions M99L and M102L were selected to test in a second round sequence optimization based on potency, stability and similar physical properties of leucine and methionine.

TABLE C-20

Results of 18G11 variants in the first round sequence optimization

| | | Nanobody tested as peri | | purified Nanobody tested | |
|---|---|---|---|---|---|
| ID | mutation | 18G11 competition alphascreen (% inhibition) | Off rate (s$^{-1}$) | IC50 pHER3 blocking HRG stimulated MCF7 (M) | Tm at pH 7 (° C.) |
| 18G11 | parental | 91-93.6% | 6.2-7.7E-4 | 2.912E-8 | 69.9 |
| HER3MS00069 | M99L | 83% | 8.1E-4 | 5.27E-8 | 71.88 |
| HER3MS00070 | M99I | 82.2% | 6.4E-4 | 3.778E-8 | 71.06 |
| HER3MS00071 | M99V | 80.9% | 8.4E-4 | 7.346E-8 | 71.06 |
| HER3MS00068 | M99G | 84.4% | 1.0E-3 | 8.881E-8 | 70.64 |
| HER3MS00072 | M102L | 88.0% | 8.2E-4 | 5.764E-8 | 70.63 |
| HER3MS00073 | M102D | 84.4% | 8.3E-4 | 8.747E-8 | 62.73 |
| HER3MS00074 | M102E | 82.7% | 4.9E-4 | 6.304E-8 | 66.1 |

In the second round 18G11 sequence optimization, two variants were made which combined the selected substitutions for humanization and chemical stability purposes. The only difference between both variants was the presence/absence of R44Q. Both variants showed an increase of around 6° C. in Tm value compared to the parental Nanobody (Table C-21). Finally, the 18G11 variant HER3MS00211 was selected as absence of the R44Q mutation resulted in a slightly better potency. The obtained percentage framework identity in the framework region was 87.6 according to the AbM definition (see Antibody Engineering, Vol 2 by Kontermann & Dübel (Eds), Springer Verlag Heidelberg Berlin, 2010).

TABLE C-21

Results of 18G11 variants in the second round sequence optimization

| ID | Mutations | IC50 18G11 competition alphascreen (M) | Off-rate (s$^{-1}$) | IC50 pHER3 blocking HRG stimulated MCF7 (M) | Tm at pH (° C.) |
|---|---|---|---|---|---|
| HER3MS18G11 parental | — | 4.4E-09 | 4.3E-4-4.7E-4 | 1.09E-8-4.61E-8 | 69.9 |
| HER3MS00125 | R44Q, S62D, E64K, T74S, A77T, K83R, M99L, M102L and Q108L | 1.4E-08 | 1.2E-03 | | 76.0 |

TABLE C-21-continued

Results of 18G11 variants in the second round sequence optimization

| ID | Mutations | IC50 18G11 competition alphascreen (M) | Off-rate (s$^{-1}$) | IC50 pHER3 blocking HRG stimulated MCF7 (M) | Tm at pH (° C.) |
|---|---|---|---|---|---|
| HER3MS00211 | E64K, T74S, A77T, M99L, K83R, M102L and Q108L | 5.4E−09 | 7.2E−04 | 1.79E−8-2.0E−8 | 75.6 |

Seven amino acid residues in 34C07 can be substituted for humanization purposes. In this case the basic variant was made, containing mutations K83R and Q108L. Then, a mini-library of the basic variant with 7 additional unique mutations spread over 6 variable positions ($2^5 \times 3 = 96$ permutations) was constructed. Mutation H93A was not investigated since this mutation is close to CDR3 which increased the chance that humanization would affect the potency of the Nanobody. The libraries were transformed in TG1 and individual colonies were picked and grown in 96 well plates. Periplasmic extracts were prepared, sequenced and screened for competition with biotinylated parental 34C07 to bind recombinant HER3-Fc. Twelve unique competitors were tested for off rate on recombinant HER3-ECD. Most clones were within a 2-fold higher $k_d$ range compared to parental 34C07 ($k_d$ 3.7E-4-3.9E-4 s$^{-1}$). The mutation W75K showed less than 40% inhibition in the 34C07 competition alphascreen and a 95-fold increase in off rate compared to parental 34C07. The substitutions G19R, V23A, V71R, A74S, V84P and V84A did not affect binding to HER3.

Analysis of post translational modification sites revealed 42% pyroglutamate formation after 4 weeks storage at 40° C. Therefore, the effect of the substitution E1D on the Nanobody potency was analysed in the second round sequence optimization. No oxidation (10 mM H$_2$O$_2$ during 3 h at room temperature), deamidation (4 weeks at 40° C.) or Asp isomerization (4 weeks at 40° C.) were identified so there was no need to substitute additional amino acids for chemical stability purposes.

Four constructs were made in the second round sequence optimization. They all contained the substitutions G19R, V23A, V71R, A74S, K83R and Q108L but were different for E1D, V84A and V84P (Table C-22). The constructs were expressed in E. coli and purified by IMAC and desalting. The purified molecules were characterized using the 34C07 competition alphascreen, off rate analysis on HER3-ECD and pHER3 blocking assay in HRG stimulated MCF7 cells. Results are summarized in Table C-22.

TABLE C-22

Results of 34C07 variants in the second round sequence optimization

| ID | Mutations | IC50 34C07 competition alphascreen (M) | Off-rate (s$^{-1}$) | IC50 pHER3 blocking MCF7 (M) | Tm (° C.) |
|---|---|---|---|---|---|
| HER3MS34C07 parental | — | 5.5E−9 | 3.0E−4-3.1E−4 | 2.49E−8 | 73.9 |
| HER3MS00123 | K83R + Q108L + G19R + V23A + V71R + A74S + V84P | 7.6E−9 | 4.6E−4 | 3.09E−8 | 76.4 |
| HER3MS00124 | K83R + Q108L + G19R + V23A + V71R + A74S + V84A | 7.1E−9 | 4.5E−4 | 3.05E−8 | 76.2 |
| HER3MS00127 | K83R + Q108L + E1D + G19R + V23A + V71R + A74S + V84P | 8.5E−9 | 4.6E−4 | 3.88E−8 | 75.6 |
| HER3MS00128 | K83R + Q108L + E1D + G19R + V23A + V71R + A74S + V84A | 6.7E−9 | 4.6E−4 | 4.05E−8 | 75.2 |

It was confirmed that the investigated substitutions did not influence the binding significantly. In addition, pHER3 blocking, off rate and Tm were similar for all tested variants and the parental 34C07 Nanobody. The final variant became HER3MS00123 and HER3MS00127 (containing the E1D mutation in case the Nanobody is N-terminally located in the multivalent construct). The percentage framework identity in the framework regions for HER3MS00123 is 89.9% and for HER3MS00127 is 88.8% based on the AbM definition.

Six amino acid residues in 17B05 can be substituted for humanization purposes and two amino acid substitutions can be analysed for chemical stability purposes. In this case the basic variant was made, containing mutations A74S, K83R and Q108L. Then, nine constructs were made containing the basic mutations and combinations of the three additional mutations which were investigated (I73N, F79Y and R93A).

The constructs were expressed in E. coli and purified by IMAC and desalting. The purified molecules were tested for their capacity to block HRG binding to HER3-Fc using alphascreen, off rate on HER3-ECD and stability using the thermal shift assay. Results are summarized in C-23.

TABLE C-23

Results of 17B05 variants in the first round sequence optimization

| ID | Mutations | IC50 HRG competition alphascreen (M) | Off-rate ($s^{-1}$) | Tm at pH 7 (° C.) |
|---|---|---|---|---|
| HER3MS17B05 parental | — | 3.4E-10-9.3E-10 | 1.8E-4-2.0E-4 | 69.8 |
| HER3MS0076 basic variant | A74S + N83R + Q108L | 7.88E-10 | 1.7E-4 | 73.6 |
| HER3MS0077 | A74S + N83R + Q108L + I73N | 7.53E-10 | NA | 72.3 |
| HER3MS0078 | A74S + N83R + Q108L + F79Y | 8.11E-10 | NA | 74.4 |
| HER3MS0079 | A74S + N83R + Q108L + R93A | 3.08E-09 | NA | 71.5 |
| HER3MS0080 | A74S + N83R + Q108L + I73N + F79Y | 7.31E-10 | 1.8E-4 | 73.6 |
| HER3MS0081 | A74S + N83R + Q108L + I73N + R93A | 5.89E-09 | NA | 69.4 |
| HER3MS0082 | A74S + N83R + Q108L + F79Y + R93A | 4.05E-09 | NA | 73.2 |
| HER3MS0083 | A74S + N83R + Q108L + I73N + F79Y + R93A | 4.95E-09 | 8.4E-4 | 71.1 |
| HER3MS0084 | A74S + N83R + Q108L + S84P | 9.4E-10 | 1.8E-4 | NA |
| HER3MS0085 | A74S + N83R + Q108L + S84A | 7.6E-10-9.4E-10 | 1.9E-4 | 74.8 |

At least a 9-fold reduction in potency was observed in the HRG blocking alphascreen when substitution R93A was introduced in the construct, whereas other substitutions resulted in a similar IC50 compared to parental 17B05. This observation was confirmed by the off rate data. Most mutations also had a small positive effect in Tm value.

Analysis of post translational modification sites revealed 25% pyroglutamate formation after 4 weeks storage at 40° C. Therefore, the effect of the substitution E1D on the Nanobody potency was analysed in the second round sequence optimization. No oxidation (10 mM $H_2O_2$ during 3 h at room temperature) or Asn deamidation (4 weeks at 40° C.) were identified so there was no need to substitute additional amino acids for chemical stability purposes.

Four constructs were made in the second round sequence optimization. They all contained the substitutions I73N, F79Y, A74S, K83R and Q108L but were different for E1D, S84A and S84P (Table C-24). The constructs were expressed in *E. coli* and purified by IMAC and desalting. The purified molecules were characterized using the HRG competition alphascreen on HER3-Fc, off rate analysis on HER3-ECD and pHER3 blocking assay in MCF7 cells. Results are summarized in Table C-24.

TABLE C-24

Results 17B05 variants in the second round sequence optimization

| ID | Mutations | HRG competition alphascreen (M) | Off-rate ($s^{-1}$) | IC50 pHER3 blocking HRG stimulated MCF7 (M) | Tm at pH 7 (° C.) |
|---|---|---|---|---|---|
| HER3MS17B05 | parental | 7.8E-10 | 1.8E-4-2.0E-4 | 4.52E-9 | 69.8 |
| HER3MS0118 | A74S + N83R + Q108L + I73N + F79Y + S84A + R93A | 6.0E-10 | 1.8E-4 | 2.69E-9 | 74.4 |
| HER3MS0119 | A74S + N83R + Q108L + I73N + F79Y + S84P + R93A | 7.9E-10 | 1.8E-4 | 1.70E-9 | 76.9 |
| HER3MS0120 | A74S + N83R + Q108L + E1D + I73N + F79Y + S84A + R93A | 7.5E-10 | 1.9E-4 | 4.28E-9 | 73.9 |
| HER3MS0121 | A74S + N83R + Q108L + E1D + I73N + F79Y + S84P + R93A | 5.5E-10 | 1.8E-4 | 3.53E-9 | 76.4 |

It was confirmed that the investigated substitutions did not influence the binding and HRG competition significantly. In addition, IC50s for pHER3 blocking were similar for all tested variants and the parental 17B05 Nanobody. Introduction of S84P had a positive effect on Tm. The final variant became HER3MS00119 and HER3MS00121 (containing the E1D mutation in case the Nanobody is N-terminally located in the multivalent construct). The percentage framework identity in the framework regions for HER3MS00119 is 89.9% and for HER3MS00121 is 88.8% based on the AbM definition.

Example 19

Generation and Expression Level Analysis of the Multivalent Sequence Optimized HER3-Specific Nanobodies with HLE Combinations were made of sequence optimized Nanobodies blocking HRG binding to HER3 (21F06, 04C07 and 17B05), a Nanobody blocking HER3 heterodimerization (17B05) and a Nanobody binding to domain II of HER3 (18G11). The ALB half life extension was located in the middle (Nb1-ALB-Nb2) or at the C-terminal position (Nb1-Nb2-ALB). The different building blocks were connected with two 9GS linkers or two 35GS linkers. The constructs were produced in *Pichia pastoris* as tagless proteins and purified via MEP hypercell or Protein A affinity chromatography, followed by desalting. A copy number screen was performed and expression yields were predicted for the clones with the highest copy number based on small scale cultures (Table C-25). Little impact of position of Nanobody building blocks and linker length on predicted yields was observed.

TABLE C-25

Results of expression level analysis of purified multivalent sequence optimized anti-HER3 Nanobodies with ALB11 HLE

| ID | Nb1 | linker | Nb2 or HLE | linker | Nb2 or HLE | Predicted yield in fermentor (g/l) |
|---|---|---|---|---|---|---|
| HER3MS00135 | 17B05 SO | 9GS | ALB11 | 9GS | 21F06 SO | 1.5 |
| HER3MS00136 | 17B05 SO | 35GS | ALB11 | 35GS | 21F06 SO | >1 |
| HER3MS00137 | 17B05 SO | 9GS | 21F06 SO | 9GS | ALB11 | 1.5 |
| HER3MS00138 | 17B05 SO | 35GS | 21F06 SO | 35GS | ALB11 | 0.5-1 |
| HER3MS00139 | 17B05 SO | 9GS | ALB11 | 9GS | 34C07 SO | 1.5 |
| HER3MS00140 | 17B05 SO | 35GS | ALB11 | 35GS | 34C07 SO | >1 |
| HER3MS00141 | 17B05 SO | 9GS | 34C07 SO | 9GS | ALB11 | 1.5 |
| HER3MS00142 | 17B05 SO | 35GS | 34C07 SO | 35GS | ALB11 | >1 |
| HER3MS00143 | 17B05 SO | 9GS | ALB11 | 9GS | 18G11 SO | 1.5 |
| HER3MS00144 | 17B05 SO | 35GS | ALB11 | 35GS | 18G11 SO | 0.5-1 |
| HER3MS00145 | 17B05 SO | 9GS | 18G11 SO | 9GS | ALB11 | 1.5 |
| HER3MS00146 | 17B05 SO | 35GS | 18G11 SO | 35GS | ALB11 | 0.5-1 |
| HER3MS00209 | 17B05 SO | 9GS | ALB11 | NA | NA | 1.5 |
| HER3MS00212 | 17B05 SO | 9GS | ALB11 | 9GS | 18G11 SO | 1 |
| HER3MS00159 | 18G11 SO | 35GS | ALB11 | 35GS | 04C07 SO | 1.5 |
| HER3MS00160 | 18G11 SO | 35GS | ALB11 | 35GS | 04C07 SO | 0.5 |
| HER3MS00161 | 18G11 SO | 35GS | 04C07 SO | 35GS | ALB11 | >1 |
| HER3MS00162 | 18G11 SO | 35GS | 04C07 SO | 35GS | ALB11 | >1 |
| HER3MS00199 | 18G11 SO | 9GS | ALB11 | 9GS | 21F06 SO | 0.5-1 |
| HER3MS00200 | 18G11 SO | 9GS | 21F06 SO | 9GS | ALB11 | 0.5-1 |
| HER3MS00207 | 18G11 SO | 9GS | ALB11 | 9GS | 17B05 SO | 0.5-1 |
| HER3MS00215 | 18G11 SO | 9GS | ALB11 | 9GS | 17B05 SO | 0.5-1 |
| HER3MS00201 | 21F06 SO | 9GS | ALB11 | 9GS | 18G11 SO | 0.5-1 |
| HER3MS00202 | 21F06 SO | 9GS | 18G11 SO | 9GS | ALB11 | 0.5-1 |
| HER3MS00210 | 21F06 SO | 9GS | ALB11 | 9GS | 18G11 SO | 0.5 |
| HER3MS00214 | 21F06 SO | 9GS | ALB11 | 9GS | 18G11 SO | 0.5 |
| HER3MS00152 | 34C07 SO | 35GS | ALB11 | 35GS | 04C07 SO | 0.5-1 |
| HER3MS00153 | 34C07 SO | 35GS | 04C07 SO | 35GS | ALB11 | 0.5-1 |
| HER3MS00154 | 34C07 SO | 35GS | 04C07 SO | 35GS | ALB11 | 0.5-1 |
| HER3MS00147 | 04C07 SO | 35GS | ALB11 | 35GS | 34C07 SO | 1.5 |
| HER3MS00149 | 04C07 SO | 35GS | 34C07 SO | 35GS | ALB11 | >1 |
| HER3MS00155 | 04C07 SO | 35GS | ALB11 | 35GS | 18G11 SO | 1.5 |
| HER3MS00157 | 04C07 SO | 35GS | 18G11 SO | 35GS | ALB11 | >1 |
| HER3MS00208 | 04C07 SO | 9GS | ALB11 | 9GS | 18G11 SO | 0.5 |
| HER3MS00213 | 04C07 SO | 9GS | ALB11 | 9GS | 18G11 SO | 0.5-1 |
| HER3MS00148 | 04C07 SO | 35GS | ALB11 | 35GS | 34C07 SO | 0.5-1 |
| HER3MS00150 | 04C07 SO | 35GS | 34C07 SO | 35GS | ALB11 | 0.5-1 |
| HER3MS00151 | 04C07 SO | 35GS | 34C07 SO | 35GS | ALB11 | 0.5-1 |
| HER3MS00156 | 04C07 SO | 35GS | ALB11 | 35GS | 18G11 SO | 0.5-1 |
| HER3MS00158 | 04C07 SO | 35GS | 18G11 SO | 35GS | ALB11 | 0.5-1 |

Example 20

Induction of HER3 Internalization by the Multivalent Sequence Optimized Nanobodies with ALB11 HLE The effect of HER3-specific multivalent sequence optimized Nanobodies with HLE on HER3 internalization was assessed using MCF-7 and MALME-3M cells as described in the previous examples. No internalization was observed when 21F06 was present in a multivalent construct. In constructs without 21F06, internalization (36-71%) was only observed when 17B05 or 04C07 was present in the N-terminal position. The results (Table C-26) were identical in both cell lines. The construct HER3MS00209 consists of sequence optimized 17B05 linked to ALB11 and did not show internalization. These results were similar to those obtained with the parental multivalent constructs and indicated that the selected multivalent panel contained molecules with different mode of actions. Two control antibodies were also tested in the internalization assay and they induced both internalization of HER3.

blocked with 3% block A (MSD) in PBS, pH7.4, 0.05% Tween20 and coated with HER3 specific capture antibody (R&D Systems, # MAB3481). Cell lysates were added and incubated for 2 h at room temperature (RT). Biotinylated anti-phospho Tyrosine antibody (R&D Systems, # BAM1676) and sulfo tag streptavidin reagent (MSD, #R32AD) were used for detection (Table C-27).

21.1 Inhibition of EGFR/HER3 and HER2/HER3 Transphosphorylation:

MDA MB468 (ATCC HTB 132) and CHO HER2/HER3 cells were serum starved and treated as described above (MDA MB468 stimulation with 50 ng/ml HRG1-β1 EGF domain; CHO HER2/HER3 cells stimulation with 100 ng/ml HRG1-β1 EGF domain). Cell lysates were tested in pHER3ECLA (Table C-27).

Multivalent sequence optimized Nanobodies with Alb11 potently inhibited HRG induced HER3 signaling in MCF-7 cells, as well as cells expressing HER2/HER3 (CHO HER2/

TABLE C-26

Percentage HER3 internalization induced by multivalent sequence optimized Nanobodies or control MAbs on MCF7 and MALME-3M cells.

| ID | Nb1 | linker | Nb2 or HLE | linker | Nb2 or HLE | % HER3 internalization MCF7 cells | % HER3 internalization MALME-3M cells |
|---|---|---|---|---|---|---|---|
| HER3MS00135 | 17B05 SO | 9GS | ALB11 | 9GS | 21F06 SO | 0 | 0 |
| HER3MS00137 | 17B05 SO | 9GS | 21F06 SO | 9GS | ALB11 | 5 | NA |
| HER3MS00143 | 17B05 SO | 9GS | ALB11 | 9GS | 18G11 SO | 62-67 | NA |
| HER3MS00207 | 18G11 SO | 9GS | ALB11 | 9GS | 17B05 SO | 4 | 9 |
| HER3MS00208 | 4C07 SO | 9GS | ALB11 | 9GS | 18G11 SO | 36.0 | 40.2 |
| HER3MS00209 | 17B05 SO | 9GS | ALB11 | NA | NA | 0-7 | 0-4 |
| HER3MS00210 | 21F06 SO | 9GS | ALB11 | 9GS | 18G11 SO | 0 | 0 |
| HER3MS00212 | 17B05 SO | 9GS | ALB11 | 9GS | 18G11 SO | 65-71 | 64-70 |
| HER3MS00213 | 4C07 SO | 9GS | ALB11 | 9GS | 18G11 SO | 48-53 | 53 |
| HER3MS00214 | 21F06 SO | 9GS | ALB11 | 9GS | 18G11 SO | 0 | 0 |
| HER3MS00215 | 18G11 SO | 9GS | ALB11 | 9GS | 17B05 SO | 0-1 | 0-6 |
| Control MAb1 | NA | NA | NA | NA | NA | 51-60 | 53-69 |
| Control MAb2 | NA | NA | NA | NA | NA | 49-61 | 50-63 |

Example 21

Inhibition of the HRG Induced pHER3 and Downstream Signaling by Multivalent Sequence Optimized Nanobodies with ALB11 HLE in Cellular Assays To determine the potency of multivalent sequence optimized Nanobodies in inhibiting ligand induced HER3 phosphorylation and EGFR/HER3 and HER2/HER3 transphosphorylation, Nanobodies were tested in cell based assays as described below.

Inhibition of ligand induced pHER3 (phosphoHER3) in MCF-7 cells (cell based electrochemiluminescence assay (ECLA)): MCF-7 cells (ATCC HTB 22) were serum starved and pre-incubated with Nanobodies (serial dilutions, starting concentration 666 nM or 167 nM) in serum-free media for 60 min at 37° C., 5% $CO_2$. Cells were stimulated with 50 ng/ml HRG1-β1 EGF domain (R&D Systems, #396-HB) for 10 min, supernatants discarded and cells lysed in cold NP-40 lysis buffer (1% NP-40, 20 mM Tris, pH8.0, 137 mM NaCl, 10% glycerol, 2 mM EDTA, protease inhibitor cocktail set III (Calbiochem), phosphatase inhibitor cocktail set II (Calbiochem)). MA6000 96 well plates (MSD, # L15XB) were HER3) or cells expressing EGFR/HER3 (MDA-MB468). In addition downstream signaling was potently inhibited. Alb11 did not abolish potency in the formats tested.

21.2 Inhibition of Downstream Signaling (pAkt/pERK1/2):

Inhibition of downstream signaling (pAkt/pERK1/2): Inhibition of ligand induced pAKT and pERK (phosphoAkt, phosphor ERK) in MCF-7 cells (cell based electrochemiluminescence assay (ECLA)): MCF-7 cells (ATCC HTB 22) were serum starved and pre-incubated with Nanobodies (serial dilutions, starting concentration 666 nM or 167 nM) in serum-free media for 60 min at 37° C., 5% CO2. Cells were stimulated with 50 ng/ml HRG1-β1 EGF domain (R&D Systems, #396-HB) for 10 min, supernatants discarded and cells lysed in cold NP-40 lysis buffer (1% NP-40, 20 mM Tris, pH8.0, 137 mM NaCl, 10% glycerol, 2 mM EDTA, protease inhibitor cocktail set III (Calbiochem), phosphatase inhibitor cocktail set II (Calbiochem)). Cell lysates were tested in Phospho-Akt (Ser473) Whole Cell Lysate Kit (MSD, # K151CAD) and Phospho-ERK1/2 Whole Cell Lysate Kit (MSD, # K111DWD) according to manufacturer's instructions (Table C-28).

Formatted sequence optimized Nanobodies were able to potently block HRG-induced downstream signalling of HER3.

TABLE C-27

Inhibition of HRG induced pHER3

| construct | MCF-7, HRG IC50 (M) | CHO HER2/HER3, HRG IC50 (M) | MDA-MB 468, HRG IC50 (M) |
|---|---|---|---|
| HER3MS00135 | 1.21E−10 (n = 4) | 1.42E−09 (n = 3) | 1.54E−10 (n = 3) |
| HER3MS00137 | 8.80E−10 | 4.71E−09 | 1.12E−10 |
| HER3MS00139 | 3.49E−09 | 6.12E−09 | |
| HER3MS00141 | 4.35E−09 | 4.58E−09 | |
| HER3MS00147 | 5.98E−09 | 9.12E−09 | |
| HER3MS00149 | 3.54E−09 | 3.58E−09 | |
| HER3MS00150 | 2.32E−09 | 5.56E−09 | 5.38E−10 |
| HER3MS00209 | 1.17E−09 (n = 3) | 4.07E−09 (n = 3) | 1.02E−09 (n = 3) |
| HER3MS00212 | 5.33E−10 (n = 4) | 4.76E−09 (n = 3) | 8.00E−10 (n = 3) |
| HER3MS00213 | 5.21E−10 (n = 3) | 4.22E−09 (n = 3) | 5.99E−10 (n = 3) |
| HER3MS00214 | 1.56E−10 (n = 3) | 1.45E−09 (n = 3) | 9.84E−11 (n = 3) |
| HER3MS00215 | 1.59E−09 (n = 4) | 5.43E−09 (n = 3) | 1.60E−09 (n = 3) |

TABLE C-28

Inhibition of HRG induced pAKt and pERK

| Nanobody | pAKT inhibition (IC50 M) | pERK inhibition (IC50 M) |
|---|---|---|
| HER3MS00135 | 1.494E−10 | 2.206E−10 |
| HER3MS00209 | 8.55E−10 | nd |
| HER3MS00212 | 5.56E−10 | 4.544E−10 |
| HER3MS00213 | 5.381E−10 | nd |
| HER3MS00214 | 1.147E−10 | nd |
| HER3MS00215 | 1.294E−09 | 3.811E−09 |

Example 22

Analysis of the HER1-HER3 Heterodimerization Blocking Capacity of the Multivalent Sequence Optimized Nanobodies with ALB11 HLE in Cellular Assays To determine the potency of multivalent sequence optimized Nanobodies in inhibiting EGFR ligand induced HER3 phosphorylation Nanobodies were tested in cell based assays as described below.

Inhibition of EGFR ligand induced pHER3 (phospho-HER3) in CHO EGFR/HER3 cells (cell based electrochemiluminescence assay (ECLA)): CHO EGFR/HER3 were serum starved and pre-incubated with Nanobodies (serial dilutions, starting concentration 666 nM or 167 nM) in serum-free media for 60 min at 37° C., 5% $CO_2$. Cells were stimulated with 100 ng/ml rhTGFα (R&D Systems, #239-A), for 10 min, supernatants discarded and cells lysed in cold NP-40 lysis buffer (1% NP-40, 20 mM Tris, pH8.0, 137 mM NaCl, 10% glycerol, 2 mM EDTA, protease inhibitor cocktail set III (Calbiochem), phosphatase inhibitor cocktail set II (Calbiochem)). MA6000 96 well plates (MSD, # L15XB) were blocked with 3% block A (MSD) in PBS, pH7.4, 0.05% Tween20 and coated with HER3 specific capture antibody (R&D Systems, # MAB3481). Cell lysates were added and incubated for 2 h at room temperature (RT). Biotinylated anti-phospho Tyrosine antibody (R&D Systems, # BAM1676) and sulfo tag streptavidin reagent (MSD, #R32AD) were used for detection (Table C-29). Multivalent sequence optimized Nanobodies containing 17B05 as building block potently inhibited EGFR ligand induced HER3 phosphorylation. Partial inhibition was observed with the multivalent Nanobody 214 (HER3MS00214), which does not include 17B05 as a building block.

TABLE C-29

Inhibition of EGFR ligand induced HER3 phosphorylation

| construct | CHO EGFR/HER3, TGFα IC50 (M) |
|---|---|
| HER3MS00135 | 1.54E−10 (n = 3) |
| HER3MS00137 | 5.078E−09 |
| HER3MS00139 | 6.952E−09 |
| HER3MS00141 | 5.636E−09 |
| HER3MS00147 | no effect |
| HER3MS00149 | nd |
| HER3MS00150 | nd |
| HER3MS00209 | 2.15E−09 (n = 3) |
| HER3MS00212 | 3.28E−09 (n = 3) |
| HER3MS00213 | 1.37E−08 (n = 3) |
| HER3MS00214 | *4.02E−09 (n = 3) |
| HER3MS00215 | 2.95E−09 (n = 3) |

*partial inhibition

Example 23

Migration Blocking Capacity of the Multivalent Sequence Optimized Nanobodies with ALB11 HLE The ability of formatted sequence optimized Nanobodies to inhibit HRG1-β1 dependent cell migration was assessed in the following assay. A431 cells (CRL 1555) were seeded in HTS Fluoroblok 96 well plate inserts (BD Falcon #351164) in the presence of Nanobodies (serial dilutions; starting at 666 nM). Media plus 500 nM HRG1-β1 extracellular domain (R&D Systems, #377-HB) was added to the bottom wells. Migrated cells were stained with CalceinAM and fluorescence detected by plate reader. Nanobodies HER3MS00135, HER3MS00212, and HER3MS00215 potently inhibited A431 cell migration (Table C-30). All tested formatted sequence optimized Nanbodies potently block ligand induced cell migration.

TABLE C-30

Inhibition of HRG induced A431 cell migration

| construct | IC50 (M) |
|---|---|
| HER3MS00135 | 2.09E−10 |
| HER3MS00209 | 1.46E−08 |
| HER3MS00212 | 4.46E−09 |
| HER3MS00213 | 7.09E−10 |
| HER3MS00214 | 8.54E−11 |
| HER3MS00215 | 9.75E−09 |

Example 24

Figure 3:
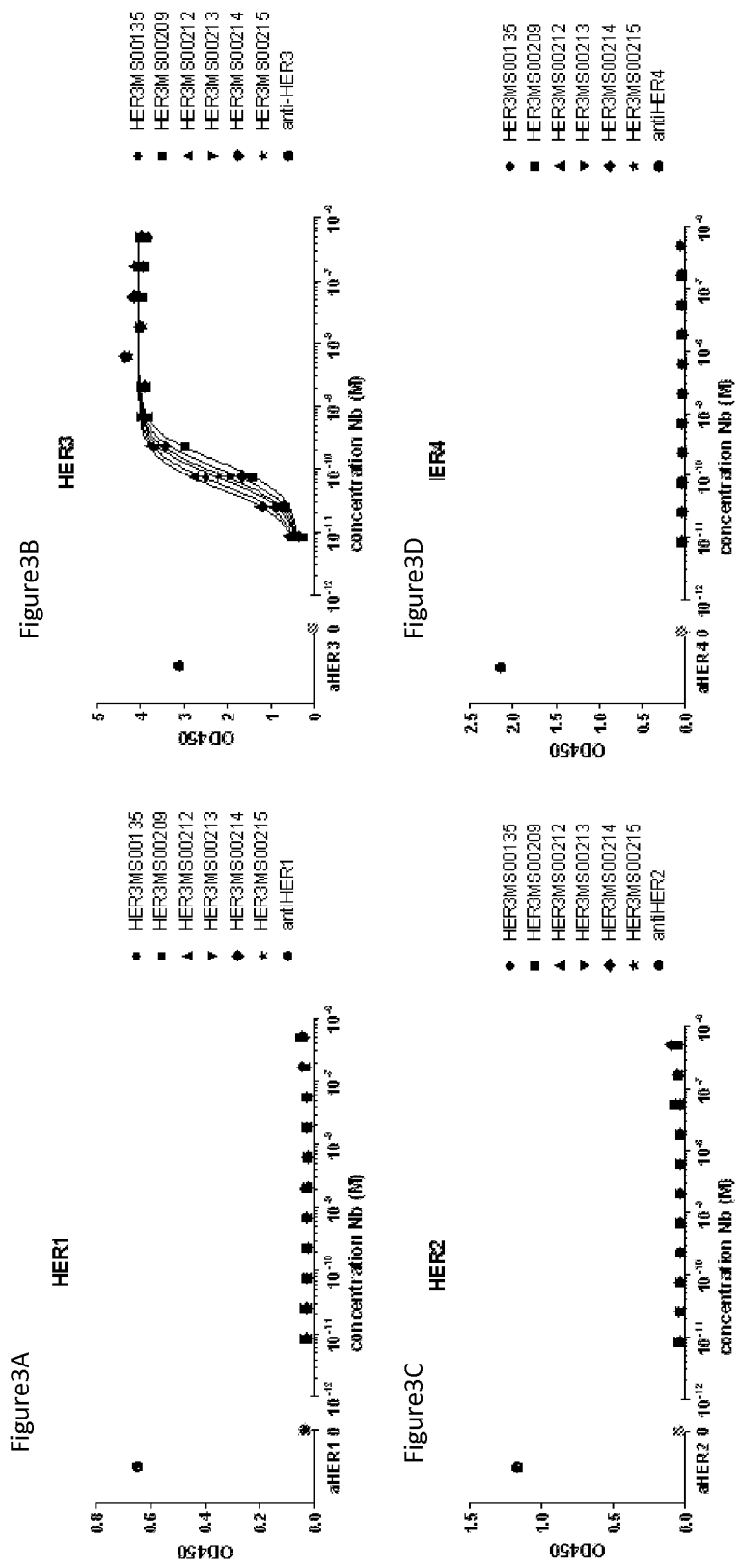

HER3-Specificity of Multivalent Sequence Optimized HER3-Specific Nanobodies with HLE Off-target binding of multivalent HER3-specific Nanobodies with HLE was assessed by measuring their binding capacity to Fc-HER1 (R&D Systems, 344-ER), Fc-HER2 (R&D Systems, 1129-ER) and Fc-HER4 (R&D Systems, 1131-ER) coated on ELISA plates. Serial dilutions of the Nanobodies starting at a concentration of 500 nM were tested and detection was done using the biotinylated ALB-specific Nanobody 02H05 and streptavidin-HRP (Dako, P0397). Binding to Fc-HER3 (R&D Systems, 348-RB) was used as positive control for the HER3-specific Nanobodies. The polyclonal antibodies anti-HER1 (R&D Systems, AF231), anti-HER2 (R&D Systems, AF1129), anti-HER3 (R&D Systems, AF234) and anti-HER4 (R&D Systems, AF1131) were used as quality control of the HER coating on the plates. The results in FIGS. 3A to 3D show that multivalent sequence optimized Nanobodies bind to HER3 (FIG. 3B) but not to the other HER proteins (FIGS. 3A, 3C and 3D).

Example 25

Species Cross-Reactivity of Multivalent Sequence Optimized HER3-Specific Nanobodies with HLE The species cross-reactivity of multivalent sequence optimized HER3-specific Nanobodies with HLE was analysed by measuring the binding capacity of these molecules to Chinese hamster ovary Flp-In cells transfected with human HER3, mouse HER3 or cyno HER3 by FACS. Serial dilutions starting at a concentration of 1 µM were incubated with the cells and detection was done using the biotinylated ALB-specific Nanobody 02H05 and streptavidin-PE (BD Pharmingen, 554061). The obtained EC50 values were maximum 4.4-fold times different when comparing binding to human HER3 with mouse HER3 or cyno HER3, suggesting cross-reactivity between human, mouse and cyno HER3 (Table C-31).

Example 26

Binding of Multivalent Sequence Optimized HER3-Specific Nanobodies with ALB11 HLE to Serum Albumin Binding affinity of three multivalent sequence optimized HER3-specific Nanobodies with ALB11 half life extension to human, mouse and cyno serum albumin was determined by surface plasmon resonance using Biacore. Serum albumin from human (Sigma #A3782), cyno (in house production) and mouse (Sigma, #A3559) were covalently bound to the sensor chip surface via amine coupling using EDC/NHS for activation and ethanolamine HCl for deactivation. Nanobodies were injected for 2 minutes at a flow rate of 45 µl/min to allow binding to chip-bound antigen. Next, binding buffer was sent over the chip at the same flow rate to allow spontaneous dissociation of bound Nanobody. The kinetic parameters kon-values (ka), koff-values (kd) and KD were calculated from the sensorgrams obtained for the different Nanobodies (Table C-32).

TABLE C-32

Kinetic parameters for multivalent sequence optimized HER3-specific Nanobodies

|  |  | Human | Cyno | Mouse |
|---|---|---|---|---|
| HER3MS00135 | ka (1/Ms) | $1.68^E5$ | $1.38^E5$ | $1.31^E5$ |
|  | kd (1/Ms) | $4.44^E{-3}$ | $4.15^E{-3}$ | $5.76^E{-2}$ |
|  | KD (nM) | 26.5 | 30.1 | 439 |
| HER3MS00212 | ka (1/Ms) | $1.64^E5$ | $1.38^E5$ | $1.19^E5$ |
|  | kd (1/Ms) | $5.21^E{-3}$ | $4.83^E{-3}$ | $7.24^E{-2}$ |
|  | KD (nM) | 31.7 | 34.9 | 610 |
| HER3MS00215 | ka (1/Ms) | $1.73^E5$ | $1.47^E5$ | $1.56^E5$ |
|  | kd (1/Ms) | $4.57^E{-3}$ | $4.29^E{-3}$ | $5.93^E{-2}$ |
|  | KD (nM) | 26.4 | 29.2 | 380 |

TABLE C-31

EC50-values of multivalent sequence optimized HER3-specific Nanobodies with HLE in a FACS binding assay to human, mouse and cyno HER3 transfected CHO-FlpIn cells

|  | Human | | Mouse | | Cyno | |
|---|---|---|---|---|---|---|
| ID | EC50 (M) | CI95 (M) | EC50 (M) | CI95 (M) | EC50 (M) | CI95 (M) |
| HER3MS00135 | 3.87E−09 | 3.228E−9 to 4.640E−9 | 1.09E−9 | 9.383E−10 to 1.263E−9 | 1.37E−9 | 1.124E−9 to 1.674E−9 |
| HER3MS00212 | 8.29E−09 | 6.895E−9 to 9.978E−9 | 4.14E−9 | 3.381E−9 to 5.081E−9 | 4.36E−9 | 3.512E−9 to 5.410E−9 |
| HER3MS00215 | 8.85E−09 | 7.294E−9 to 1.074E−8 | 6.30E−9 | 5.144E−9 to 7.710E−9 | 6.42E−9 | 5.067E−9 to 8.128E−9 |
| HER3MS00214 | 9.07E−09 | 7.451E−9 to 1.103E−8 | 2.06E−9 | 1.704E−9 to 2.497E−9 | 2.77E−9 | 2.213E−9 to 3.462E−9 |
| HER3MS00213 | 9.21E−09 | 7.442E−9 to 1.139E−8 | 1.18E−8 | 9.070E−9 to 1.527E−8 | 6.59E−9 | 5.358E−9 to 8.115E−9 |
| HER3MS00209 | 6.43E−09 | 5.366E−9 to 7.709E−9 | 3.92E−9 | 3.289E−9 to 4.682E−9 | 4.10E−9 | 3.327E−9 to 5.040E−9 |

Example 27

Inhibition of pHER3 and Downstream Signaling in Human Cancer Cell Lines

Formatted sequence optimized Nanobodies potently inhibit pHER3 and downstream signaling in human cancer cell lines as shown for MCF-7 (Example 21 above) and others like BxPC3 a pancreatic cancer cell line and BT-474 a breast cancer cell line.

17B05 and formatted Nanobodies including sequence optimized 17B05 (HER3MS00119) as building block inhibit HER3 signaling in both EGFR/HER3 driven (in BxPC3 cells) as well as HER2/HER3 (BT-474, Her2 overexpressing cell line) cell lines.

BxPC3 (ATCC CRL-1687) and BT-47 (ATCC HTB-20) cells were serum starved and pre-incubated with Nanobodies (serial dilutions, starting concentration 167 nM) for 60 min at 37° C., 5% $CO_2$. Cells were stimulated with 100 ng/ml HRG1-β1 EGF domain (R&D Systems, #396-HB) for 10 min, supernatants discarded and cells lysed in cold RIPA lysis buffer (1% NP-40 (Nonidet P40), 0.5% (V/V) Sodium-Deoxycholat, 0.1% (V/V) SDS, 50 mM Tris/HCl, pH 7.5, 150 mM NaCl, 5 mM EDTA, protease inhibitor cocktail set III (Calbiochem), phosphatase inhibitor cocktail set II (Calbiochem)) for 45 min at 4° C. After centrifugation, 4× sample buffer (Biorad #161-0791) was added to the supernatants and samples analysed by SDS-PAGE (Criterion XT precast get, 4-12%, Bis Tris, Biorad #345-0125) followed by WB. Detection antibodies: pHER3Tyr1289 (Cell Signaling#4791), pHER3 pTyr1197 (Cell Signaling#4561), pAkt (Ser473) (Cell Signaling#4060), pERK1/2 (Thr202/Thr204) (Cell Signaling#9101), HER3 (Millipore #05-390), Akt (Cell Signaling#9272), EKR1/2 (Cell Signaling#4695).

Figure 6:
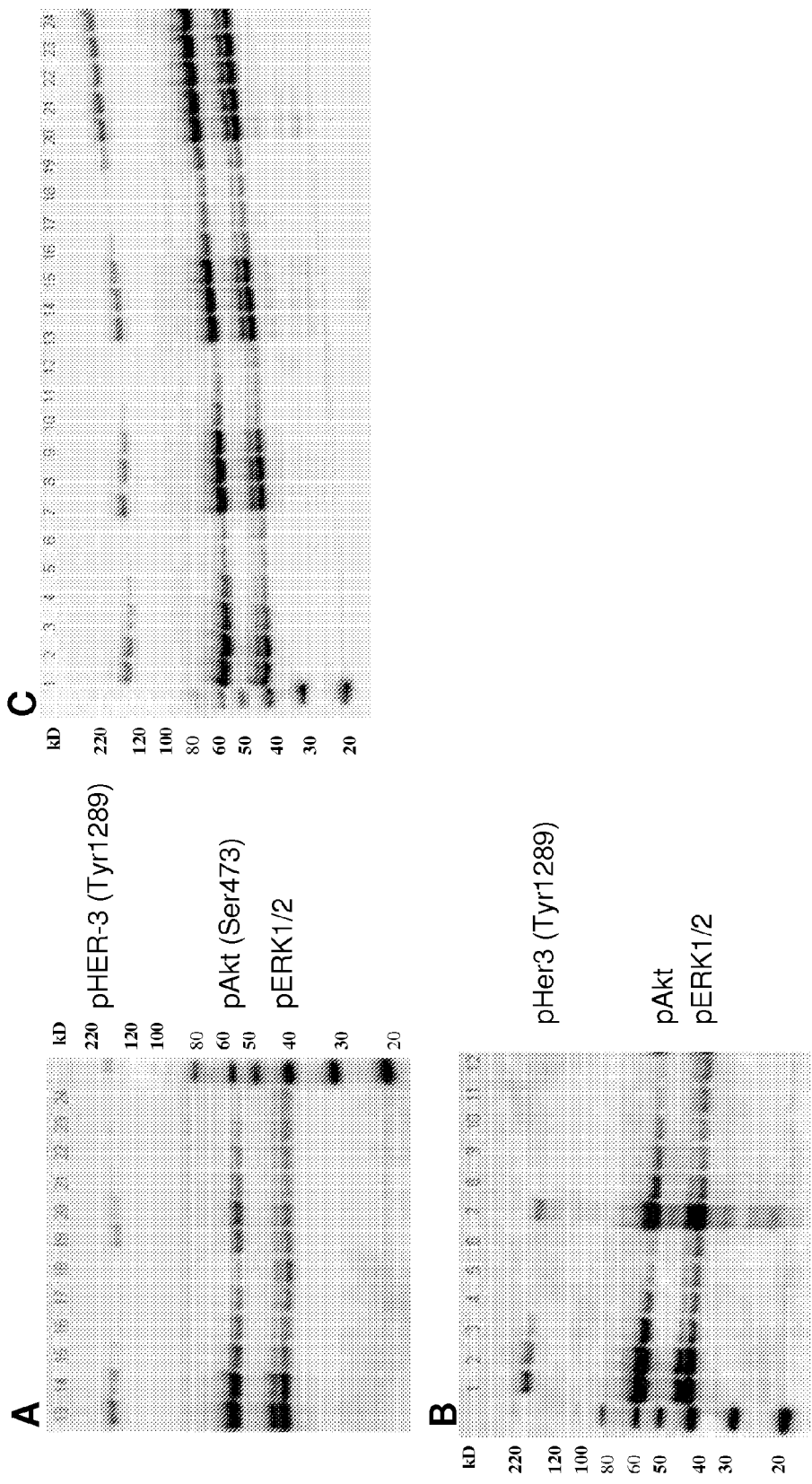
FIGS. 6A to 6C show Western Blots showing the inhibition of pHER3 and downstream signalling in BxPC3 pancreatic cancer cells by formatted sequence optimized Nanobodies (Example 28).

The results are shown in FIGS. 5A and 5B, as well as FIGS. 6A to 6C. FIG. 5 shows the inhibition of pHER3 and downstream signalling in BT-474 breast cancer cells by formatted sequence optimized Nanobodies: FIG. 5A): lanes 1-6 Nanobody HER3MS00135 (0, 0.65, 2.7, 10, 42, 167 nM), lanes 7-12 Nanobody HER3MS00212 (0, 0.65, 2.7, 10, 42, 167 nM), lanes 13-18 Nanobody HER3MS00215 (0, 0.65, 2.7, 10, 42, 167 nM), lane 19 untreated, unstimulated cells. FIG. 5B): lanes 7-12 Nanobody HER3MS00119 (0, 0.65, 2.7, 10, 42, 167 nM). FIG. 6 shows the inhibition of pHER3 and downstream signalling in BxPC3 breast cancer cells by formatted sequence optimized Nanobodies: FIG. 6A): lanes 13-18 Nanobody HER3MS00 119 (0, 0.65, 2.7, 10, 42, 167 nM), lanes 19-24 HER3MS00135 (0, 0.65, 2.7, 10, 42, 167 nM). FIG. 6B) lanes 1-6 HER3MS00213 (0, 0.65, 2.7, 10, 42, 167 nM), 7-12 HER3MS00214 (0, 0.65, 2.7, 10, 42, 167 nM). FIG. 6C): lanes 1-6 HER3MS00209 (0, 0.65, 2.7, 10, 42, 167 nM), lanes 7-12 HER3MS00212 (0, 0.65, 2.7, 10, 42, 167 nM), lanes 13-18 HER3MS00215 (0, 0.65, 2.7, 10, 42, 167 nM), lane 19 untreated, unstimulated cells, lanes 20-24 unrelated control Nanobody (0.65, 2.7, 10, 42, 167 nM).

Example 28

A549 In Vivo Model: Inhibition of Tumor Growth by Formatted Sequence Optimized Nanobodies To assess the efficacy of formatted sequence optimized Nanobodies, A549 xenograft model of human lung cancer was established in nude mice and the inhibition of tumor growth was assessed at multiple doses. T-Cell deficient nude/nude mice (6 weeks old female mice originated at NIH, outbread, albino background) were purchase from Charles River Laboratories (Wilmington, Mass.) for xenograft studies. A549 cells (ATCC, CCL-185) were grown in culture media (RPMI, 10% FBS; L-glutamine, 37° C., 5% $CO_2$). Mice were injected with 5E+6 cells in 100 μl PBS on the right flank subcutaneously. Initial tumor growth and body weight was monitored. After 13 days tumors reached an average volume of 174 $mm^3$ and mice were randomized into groups of 10. Mice were dosed intra-peritoneally every third day with 1 mg/kg, 3 mg/kg, or 10 mg/kg of Nanobodies HER3MS00135, HER3MS00212, or HER3MS00215, respectively. Alb11 was used as control at 10 mg/kg. PBS was used as vehicle control. Treatment duration was 20 days. Tumor volume and body weight were recorded twice per week. Percent body weight data were analyzed by One Way ANOVA followed by Dunnett's post-hoc comparisons versus the controls. Tumor volume data were analyzed by Repeated Measures ANOVA followed by post-hoc Bonferrioni pair wise comparisons ($\alpha=0.05$).

Figure 7A:
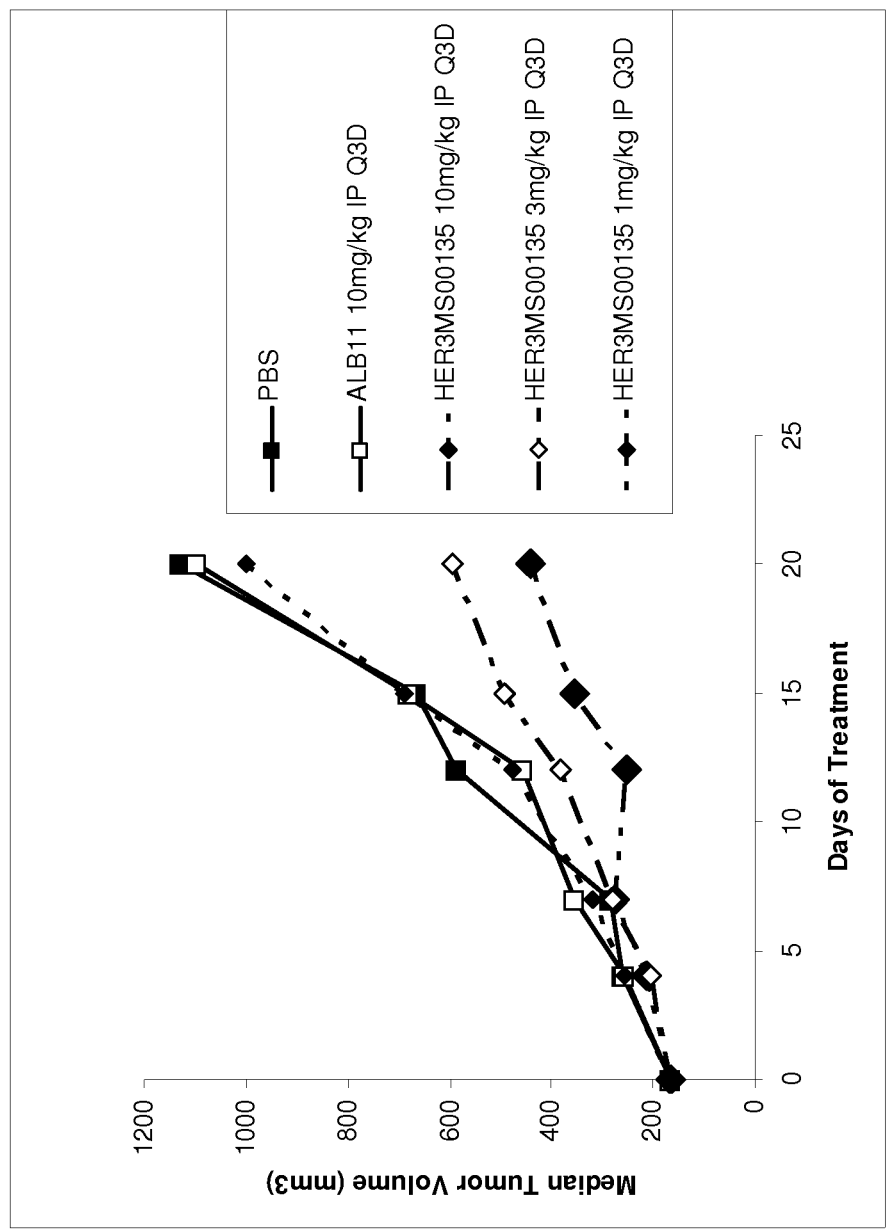
FIGS. 7A to 7C show the inhibition of tumor growth (median tumor volume over time) of A549 xenograft tumors treated with Nanobodies HER3MS00135 (FIG. 7A), HER3MS00212 (FIG. 7B), and HER3MS00215 (FIG. 7C), respectively.
Figure 7B:
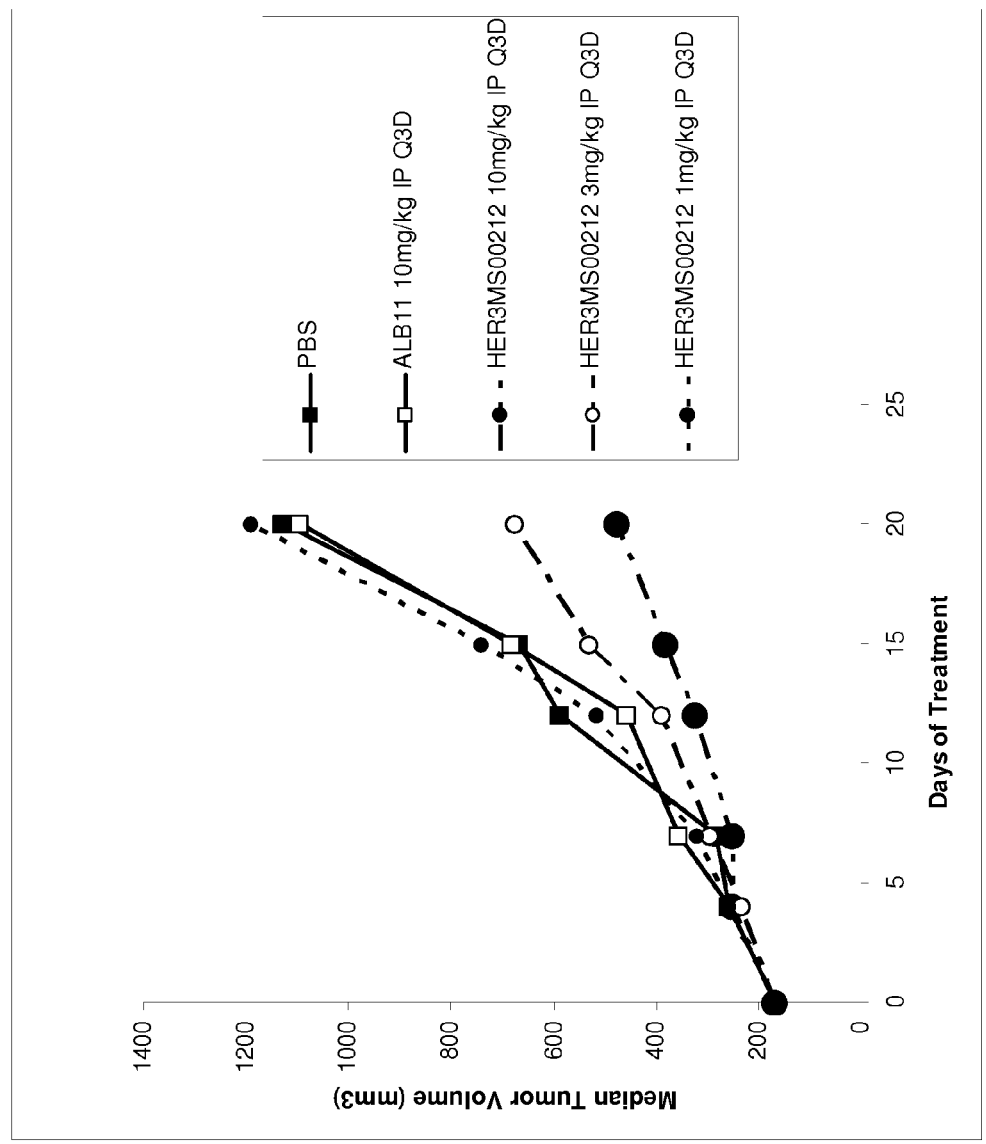
Figure 7C:
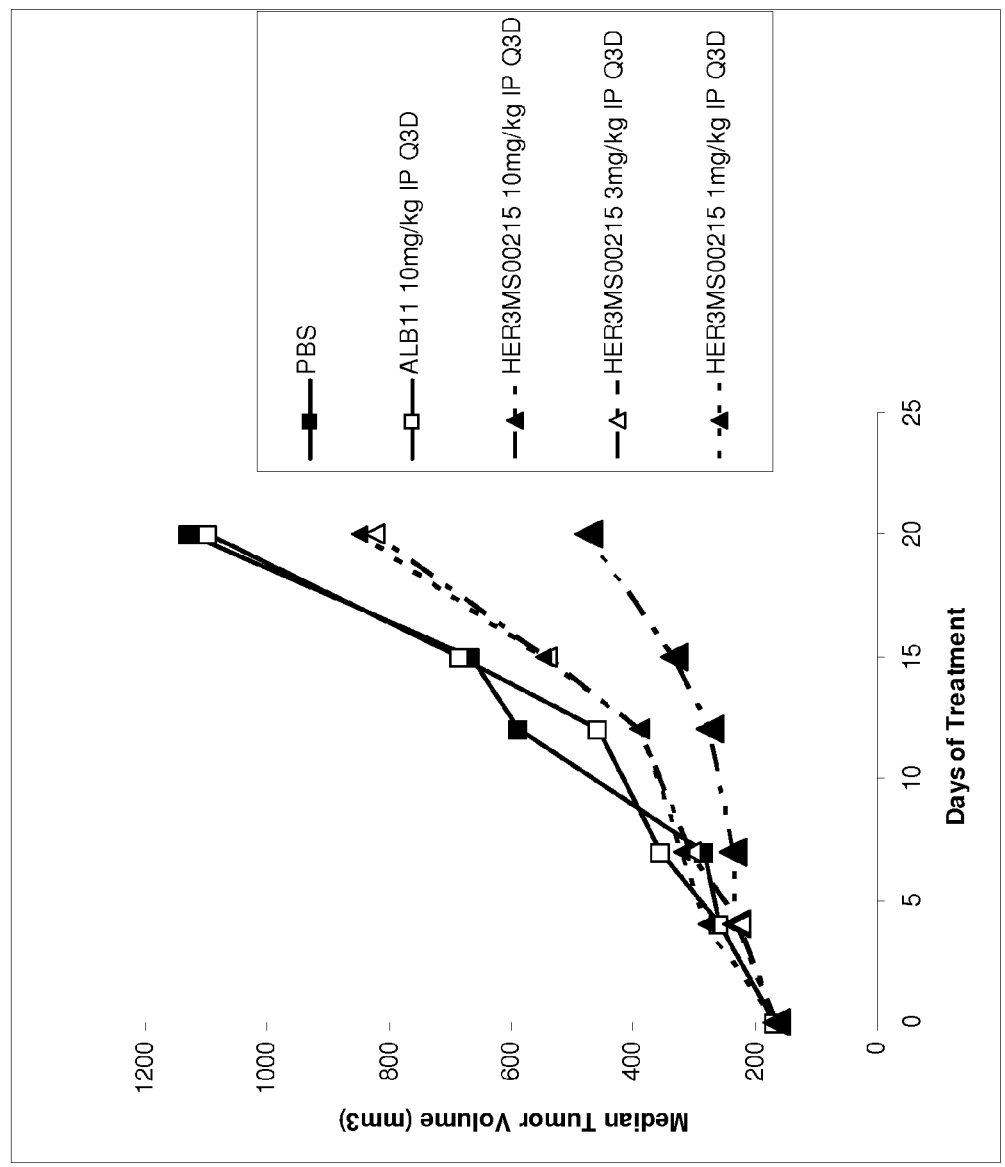

The median tumor volumes from each control and treatment group are shown in FIGS. 7A to 7C (for HER3MS00135, HER3MS00212 and HER3MS00215, respectively).

Administration of the Nanobodies resulted in significant dose dependent tumor growth inhibition of the human lung cancer xenograft model when compared to tumors treated with PBS vehicle control or Alb11.

---

SEQUENCE LISTING (446 sequences)

SEQ ID NO: 1 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 2 - protein, 642 aa, Gallus gallus
MRANDALQVLGLLFSLARGSEVGNSQAVCAGTLNGLSVTGDAQHQYRTLHKMYNNCEIVMGNLEIVLIDHTQDLSFLQTIREVTGYILIAMNVFSTLPLRNLRVIRGTQFYEEKYALFVLLNYNPNATHALRQLGLNRLTEILAGGVYIEKNEQLCHVDTVEWRDIMRDPRLEPVVGDNGRACAPCHESCGGHCWGPGPEDCQQLTKTICAPQCNGRCFGRAPNECCHEECAGGCTGPLQTHCFACRHFNDSGACVPLCPQPLIYNKLTFQLEPNPDTKYQYGSVCVRSCPHNFVVDQSSCVRACPSNKMEVEKNGLKMCEPCAGLCPKACEGTGAGSHYQTVDSSNIDSFVNCTKILGNLDFLITGLEGDPWRNISALDPEKLNVFRTVREITGYLNIQSWPKHMHNFSVFSNLETIGGRSLYNRGFSLLIMKNDNVTSLGLRSLREVSAGRVYITENRRLCYLHTVQWAALSRRRADLDIRNNKPRGKCQQEGKVCDPLCSADGCWGPGPAQCLSCRHYSRRGVCVESCSFTQGETREFAEGTECFECHPECERVEGGITCNGSGADTCTRCAHYRDGPHCVERCPEGILGERGPIYKYPDSSRECRPCHENCTRGCTGPLLQDCLGDALPSARRAPTVI

SEQ ID NO: 3 - protein, 649 aa, Macaca fascicularis
MRANGALQVLGLLFNLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWKDIVRDQDAEIVVKDNGRSCPLCHEVCKGRCWGPGPEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMYNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTHHHHHH

SEQ ID NO: 4 - protein, 649 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTHHHHHH

SEQ ID NO: 5 - protein, 642 aa, Artificial Sequence
  Description of Artificial Sequence: Synthetic chimeric sequence
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGRCFGRAPNECCHEECAGGCTGPLQTHCFACRHFNDSGACVPLCPQPLIYNKLTFQLEPNPDTKYQYGSVCVRSCPHNFVVDQSSCVRACPSNKMEVEKNGLKMCEPCAGLCPKACEGTGAGSHYQTVDSSNIDSFVNCTKILGNLDFLITGLEGDPWRNISALDPEKLNVFRTVREITGYLNIQSWPKHMHNFSVFSNLETIGGRSLYNRGFSLLIMKNDNVTSLGLRSLREVSAGRVYITENRRLCYLHTVQWAALSRRRADLDIRNNKPRGKCQQEGKVCDPLCSADGCWGPGPAQCLSCRHYSRRGVCVESCSFTQGETREFAEGTECFECHPECERVEGGITCNGSGADTCTRCAHYRDGPHCVERCPEGILGERGPIYKYPDSSRECRPCHENCTRGCTGPLLQDCLGDALPSARRAPTVI

SEQ ID NO: 6 - protein, 642 aa, Artificial Sequence
  Description of Artificial Sequence: Synthetic chimeric sequence
MRANDALQVLGLLFSLARGSEVGNSQAVCAGTLNGLSVTGDAQHQYRTLHKMYNNCEIVMGNLEIVLIDHTQDLSFLQTIREVTGYILIAMNVFSTLPLRNLRVIRGTQFYEEKYALFVLLNYNPNATHALRQLGLNRLTEILAGGVYIEKNEQLCHVDTVEWRDIMRDPRLEPVVGDNGRACAPCHESCGGHCWGPGPEDCQQLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGAGSHYQTVDSSNIDSFVNCTKILGNLDFLITGLEGDPWRNISALDPEKLNVFRTVREITGYLNIQSWPKHMHNFSVFSNLETIGGRSLYNRGFSLLIMKNDNVTSLGLRSLREVSAGRVYITENRRLCYLHTVQWAALSRRRADLDIRNNKPRGKCQQEGKVCDPLCSADGCWGPGPAQCLSCRHYSRRGVCVESCSFTQGETREFAEGTECFECHPECERVEGGITCNGSGADTCTRCAHYRDGPHCVERCPEGILGERGPIYKYPDSSRECRPCHENCTRGCTGPLLQDCLGDALPSARRAPTVI

SEQ ID NO: 7 - protein, 642 aa, Artificial Sequence
  Description of Artificial Sequence: Synthetic chimeric sequence
MRANDALQVLGLLFSLARGSEVGNSQAVCAGTLNGLSVTGDAQHQYRTLHKMYNNCEIVMGNLEIVLIDHTQDLSFLQTIREVTGYILIAMNVFSTLPLRNLRVIRGTQFYEEKYALFVLLNYNPNATHALRQLGLNRLTEILAGGVYIEKNEQLCHVDTVEWRDIMRDPRLEPVVGDNGRACAPCHESCGGHCWGPGPEDCQQLTKTICAPQCNGRCFGRAPNECCHEECAGGCTGPLQTHCFACRHFNDSGACVPLCPQPLIYNKLTFQLEPNPDTKYQYGSVCVRSCPHNFVVDQSSCVRACPSNKMEVEKNGLKMCEPCAGLCPKACEGTGAGSHYQTVDSSNIDSFVNCTKILGNLDFLITGLEGDPWRNISALDPEKLNVFRTVREITGYLNIQSWPKHMHNFSVFSNLETIGGRSLYNRGFSLLIMKNDNVTSLGLRSLREVSAGRVYITENRRLCYLHTVQWAALSRRRADLDIRNNKPRGKCQQEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTM

SEQ ID NO: 8 - protein, 1210 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCKLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 9 - protein, 1255 aa, Homo sapiens [sequence omitted]

SEQ ID NO: 10 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 11 - protein, 115 aa, Artificial Sequence [sequence omitted]

SEQ ID NO: 12 - protein, 115 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTQVTVSS

SEQ ID NO: 13 - protein, 118 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSS

SEQ ID NO: 14 - protein, 114 aa, Artificial Sequence
  Description of Artificial Sequence: Synthetic Nanobody sequence
EVQLVESGGGLVQAGGSLRLSCAASGLTFGSAPMGWYRQAPGKERELVAYISGDERIWYGDSVKGRFTISRDTTKNTLYLQMNSLKPEDTAVYYCVSDVKVRHWGQGTQVTVSS

SEQ ID NO: 15 - protein, 113 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSS

SEQ ID NO: 16 - protein, 122 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSS

SEQ ID NO: 17 - protein, 122 aa, Artificial Sequence
  Description of Artificial Sequence: Synthetic Nanobody sequence
EVQLVESGGGLVQPGGSLRLSCAASGTLFKINAMGWYRQAPGKQRELVALITSSDTTDYAESVEGRFTISRDNTWNAVYLQMNSLKPEDTAVYYCHSDHYSMGVPEKRVIMYGQGTQVTVSS

SEQ ID NO: 18 - protein, 120 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSS

SEQ ID NO: 19 - protein, 127 aa, Artificial Sequence
  Description of Artificial Sequence: Synthetic Nanobody sequence
EVQLVESGGGLVQAGGSLRLSCAASGFTFDDYAIGWFRQAPGKEREGVSCISSSDGSTVYADSVKGRFTISSDNAKNTVYLQMNSLKPEDTAVYYCAAERRRGYSDLCRFYYGMDYWGKGTQVTVSS

SEQ ID NO: 20 - protein, 125 aa, Artificial Sequence
  Description of Artificial Sequence: Synthetic Nanobody sequence
EVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSS

SEQ ID NO: 21 - protein, 127 aa, Artificial Sequence
  Description of Artificial Sequence: Synthetic Nanobody sequence
EVQLVESGGGLVQPGGSLRLSCAASGFTFDYYTIGWFRQAPGKEREGVSCISSRDGDSYYADSVKGRFTISRDNAKNTAYLQMNSLKPEDTAVYYCAASASDYGLGLELFHDEYNYWGQGTQVTVSS

SEQ ID NO: 22 - protein, 125 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTQVTVSS

SEQ ID NO: 23 - protein, 127 aa, Artificial Sequence
  Description of Artificial Sequence: Synthetic Nanobody sequence
EVQLVESGGGLVQAGGSLRLSCAASGFTFDGYAIGWFRQAPGKEREGVSCISGGDGRSYYADSVKGRFTVSSDNAKNTLYLEMNSLKPEDTAVYYCAVIWGPYCSDSYEYLYEYDYWGQGTQVTVSS

SEQ ID NO: 24 - protein, 127 aa, Artificial Sequence
  Description of Artificial Sequence: Synthetic Nanobody sequence
EVQLVESGGGLVQAGGSLRLSCAASGFTFDDYTIGWFRQAPGKEREEISCISNNDGSTYYTNSVKGRFTISSDNAKNTVYLQMNSLKPEDTAVYYCAASPHGCWYDLIPLQADFGSWGQGTQVTVSS

SEQ ID NO: 25 - protein, 121 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSS

SEQ ID NO: 26 - protein, 114 aa, Artificial Sequence
  Description of Artificial Sequence: Synthetic Nanobody sequence
EVQLVESGGGLVQPGGSLKLSCVASGSMFRFYHMAWYRQAPGEQRELVARIYTGGDTIYGDSVLGRFTISRDNSKNTVYLQMNTLKPEDTGVYYCNAFREYHIWGQGTQVTVSS

SEQ ID NO: 27 - DNA, 414 bp, Artificial Sequence
  Description of Artificial Sequence: Synthetic Nanobody sequence
gaggtgcaattggtggagtctgggggaggcttggtgcagcctggggggtctctgagactctcctgtgtagcctctggattcacgttcagttcctactggatgtattgggtccgtcaggctccagggaagggggtcgagtgggtctcagcaattagtcctggtggtgttgaacgatatacagactccgtgaagggccgattcaccatctccagagacaacgccaaaaacacactgtatctccaaatgaacagtctgaaatctgaggacacggccatgtattactgtgcacgactaacatcttttgccacacccgagagccaggggacccaggtcaccgtctcctcagcggccgcagaacaaaaactcatctcagaagaggatctgaatggggccgcacatcatcatcatcatcat

SEQ ID NO: 28 - DNA, 423 bp, Artificial Sequence
  Description of Artificial Sequence: Synthetic Nanobody sequence
gaggtgcaattggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggacccaggtcaccgtctcctcagcggccgcagaacaaaaactcatctcagaagaggatctgaatggggccgcacatcatcatcatcatcat

SEQ ID NO: 29 - DNA, 411 bp, Artificial Sequence
  Description of Artificial Sequence: Synthetic Nanobody sequence
gaggtgcaattggtggagtctgggggaggattggtgcaggctgggggctctctgagactctcctgtgcagcctctggactgacgttcggtagcgcgcctatgggctggtaccgccaggctccagggaaggagcgcgagttggtcgcttatattagtggtgatgagagaatatggtatggagactctgtgaaggggcgattcaccatctccagagacactaccaagaacacgctgtatctgcaaatgaacagcctgaaacctgaggacacggccgtttattattgtgtatcagatgttaaagtcaggcactggggccaggggacccaggtcaccgtctcctcagcggccgcagaacaaaaactcatctcagaagaggatctgaatggggccgcacatcatcatcatcatcat

SEQ ID NO: 30 - DNA, 408 bp, Artificial Sequence
  Description of Artificial Sequence: Synthetic Nanobody sequence
gaggtgcaattggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggacccaggtcaccgtctcctcagcggccgcagaacaaaaactcatctcagaagaggatctgaatggggccgcacatcatcatcatcatcat

SEQ ID NO: 31 - DNA, 435 bp, Artificial Sequence
  Description of Artificial Sequence: Synthetic Nanobody sequence
gaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggacccaggtcaccgtctcctcagcggccgcagaacaaaaactcatctcagaagaggatctgaatggggccgcacatcatcatcatcatcat

SEQ ID NO: 32 - DNA, 435 bp, Artificial Sequence
  Description of Artificial Sequence: Synthetic Nanobody sequence
gaggtgcaattggtggagtctgggggaggcttggtgcagcctggggggtctctgagactctcctgtgcagcctctggaacgctcttcaaaatcaacgccatgggctggtaccgccaggctccagggaagcagcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggacccaggtcaccgtctcctcagcggccgcagaacaaaaactcatctcagaagaggatctgaatggggccgcacatcatcatcatcatcat

SEQ ID NO: 33 - DNA, 429 bp, Artificial Sequence
  Description of Artificial Sequence: Synthetic Nanobody sequence
gaggtgcaattggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggacccaggtcaccgtctcctcagcggccgcagaacaaaaactcatctcagaagaggatctgaatggggccgcacatcatcatcatcatcat

SEQ ID NO: 34 - DNA, 450 bp, Artificial Sequence
  Description of Artificial Sequence: Synthetic Nanobody sequence
gaggtgcaattggtggagtctgggggaggcttggtgcaggctggggggtctctgagactctcctgtgcagcctctggattcactttcgatgattatgccataggctggttccgccaggccccagggaaggagcgtgagggggtctcatgtattagtagtagtgatggtagcacagtctatgcagactccgtgaagggccgattcaccatctccagtgacaacgccaagaacacggtgtatctgcaaatgaacagcctgaaacctgaggacacggccgtttattactgtgcagcagaacgacggaggggctatagcgatttatgtaggttttactacggcatggactactggggcaaagggacccaggtcaccgtctcctcagcggccgcagaacaaaaactcatctcagaagaggatctgaatggggccgcacatcatcatcatcatcat

SEQ ID NO: 35 - DNA, 444 bp, Artificial Sequence
  Description of Artificial Sequence: Synthetic Nanobody sequence
gaggtgcaattggtggagtctgggggcggattgatgcaggctggggactctctgagactctcctgtgcagcctctggacgggccttcagtagctatgccttaggctggttccgccgggctccagggaaggagcgtgagtgtgtagcagcgactgaccggcttggtgataacacatactttccagattccgtgaagggccgattcaccatctccagagacaacgccaagaacacactgtatctacaaatgaacaaccttaagcctgaggacacggccgtttattactgcgcagcaggggccgttcggtacggtgttagtacgagtccgatgaactataactactggggccaggggacccaggtcaccgtctcctcagcggccgcagaacaaaaactcatctcagaagaggatctgaatggggccgcacatcatcatcatcatcat

SEQ ID NO: 36 - DNA, 450 bp, Artificial Sequence
  Description of Artificial Sequence: Synthetic Nanobody sequence
gaggtgcaattggtggagtctgggggaggcttggtgcagcctggggggtctctgagactctcctgtgcagcctctggattcacttttgattattataccataggctggttccgccaggccccagggaaggagcgcgagggggtctcatgtattagtagtagggatggtgactcatactatgcagactccgtgaagggccgattcaccatctccagagacaacgccaagaacacggcgtatctgcaaatgaacagcctgaaacctgaggacacggccgtttattactgtgcagcatcagcttctgactacgggttggggttggagttgttccacgatgagtataactactggggccaggggacccaggtcaccgtctcctcagcggccgcagaacaaaaactcatctcagaagaggatctgaatggggccgcacatcatcatcatcatcat

SEQ ID NO: 37 - DNA, 444 bp, Artificial Sequence
  Description of Artificial Sequence: Synthetic Nanobody sequence
gaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggacccaggtcaccgtctcctcagcggccgcagaacaaaaactcatctcagaagaggatctgaatggggccgcacatcatcatcatcatcat

SEQ ID NO: 38 - DNA, 450 bp, Artificial Sequence
  Description of Artificial Sequence: Synthetic Nanobody sequence
gaggtgcaattggtggagtctgggggaggcttggtgcaggctggggggtctctgagactctcctgtgcagcctctggattcactttcgatggttatgccataggctggttccgccaggccccagggaaggagcgtgagggggtctcatgtattagtggtggtgatggccgctcatactatgcagactccgtgaagggccgattcaccgtctccagtgacaacgccaagaacacgctgtatctggaaatgaacagcctgaaacctgaggacacggccgtttattactgtgcagtcatatggggcccttactgtagcgactcgtatgagtatttgtatgagtatgactactggggccaggggacccaggtcaccgtctcctcagcggccgcagaacaaaaactcatctcagaagaggatctgaatggggccgcacatcatcatcatcatcat

SEQ ID NO: 39 - DNA, 450 bp, Artificial Sequence
  Description of Artificial Sequence: Synthetic Nanobody sequence
gaggtgcaattggtggagtctgggggaggcttggtgcaggctggggggtctctgagactctcctgtgcagcctctggattcactttcgatgattataccataggctggttccgccaggccccagggaaggagcgtgaggagatctcatgtattagtaacaatgatggtagcacatactatacaaactccgtgaagggccgattcaccatctccagtgacaacgccaagaacacggtgtatctgcaaatgaacagcctgaaacctgaggacacggccgtttattactgtgcagcgtccccccatggctgctggtacgacctaataccccttcaggctgactttggttcctggggccaggggacccaggtcaccgtctcctcagcggccgcagaacaaaaactcatctcagaagaggatctgaatggggccgcacatcatcatcatcatcat

SEQ ID NO: 40 - DNA, 432 bp, Artificial Sequence
  Description of Artificial Sequence: Synthetic Nanobody sequence
gaggtgcaattggtggagtctgggggagggttggtgcagcctggggggtctctgagactctcctgttcagcctctggaagcatcttcggtctcaatgccatgggctggtaccgccagactccagggaaggagcgcgagttggtcgcaggtattactagtattactagagttggtagtacaaggtatgcggactccgcgaagggccgattcaccatctccggagactacgccaagaacacggtgtatctgcaaatgaacagcctgaaacctgaggacacgggcgtttattactgtcggatgtcaatcgttaaaagtggtggtgctgactactggggtcaggggacccaggtcaccgtctcctcagcggccgcagaacaaaaactcatctcagaagaggatctgaatggggccgcacatcatcatcatcatcat

SEQ ID NO: 41 - DNA, 411 bp, Artificial Sequence
  Description of Artificial Sequence: Synthetic Nanobody sequence
gaggtgcaattggtggagtctgggggaggcttggtgcagcctggggggtctctgaagctctcctgtgtagcctctggaagcatgttcagattctatcacatggcctggtaccgccaggctccaggggagcagcgcgagctggtcgcacgtatctatactggtggtgacacaatctatggagactccgtgctgggccgattcaccatctccagagacaattccaagaacacggtgtatctacaaatgaacaccctgaaacctgaggacacgggcgtctattactgtaatgccttcagggagtatcacatctggggccaggggacccaggtcaccgtctcctcagcggccgcagaacaaaaactcatctcagaagaggatctgaatggggccgcacatcatcatcatcatcat

SEQ ID NO: 42 - protein, 30 aa, Artificial Sequence
  Description of Artificial Sequence: Synthetic Framework1 sequence
EVQLVESGGGLVQPGGSLRLSCVASGFTFS

SEQ ID NO: 43 - protein, 30 aa, Artificial Sequence
  Description of Artificial Sequence: Synthetic Framework1 sequence
EVQLVESGGGLVQPGGSLRLSCAASGSIGG

SEQ ID NO: 44 - protein, 30 aa, Artificial Sequence
  Description of Artificial Sequence: Synthetic Framework1 sequence
EVQLVESGGGLVQAGGSLRLSCAASGLTFG

SEQ ID NO: 45 - protein, 30 aa, Artificial Sequence
  Description of Artificial Sequence: Synthetic Framework1 sequence
EVQLVESGGGLVQAGGSLRLSCAASGFTFS

SEQ ID NO: 46 - protein, 30 aa, Artificial Sequence
  Description of Artificial Sequence: Synthetic Framework1 sequence
EVQLVESGGGLVQPGGSLRLSCAASGTLFK

SEQ ID NO: 47 - protein, 30 aa, Artificial Sequence; identical to SEQ ID NO: 46
  Description of Artificial Sequence: Synthetic Framework1 sequence

SEQ ID NO: 48 - protein, 30 aa, Artificial Sequence
  Description of Artificial Sequence: Synthetic Framework1 sequence
EVQLVESGGGLVQPGGSLGLSCVASGSIFR

SEQ ID NO: 49 - protein, 30 aa, Artificial Sequence
  Description of Artificial Sequence: Synthetic Framework1 sequence
EVQLVESGGGLVQAGGSLRLSCAASGFTFD

SEQ ID NO: 50 - protein, 30 aa, Artificial Sequence
  Description of Artificial Sequence: Synthetic Framework1 sequence
EVQLVESGGGLMQAGDSLRLSCAASGRAFS

SEQ ID NO: 51 - protein, 30 aa, Artificial Sequence
  Description of Artificial Sequence: Synthetic Framework1 sequence
EVQLVESGGGLVQPGGSLRLSCAASGFTFD

SEQ ID NO: 52 - protein, 30 aa, Artificial Sequence
  Description of Artificial Sequence: Synthetic Framework1 sequence
EVQLVESGGGLVQAGGSLRLSCAASGRTYY

SEQ ID NO: 53 - protein, 30 aa, Artificial Sequence; identical to SEQ ID NO: 49
  Description of Artificial Sequence: Synthetic Framework1 sequence

SEQ ID NO: 54 - protein, 30 aa, Artificial Sequence; identical to SEQ ID NO: 49
  Description of Artificial Sequence: Synthetic Framework1 sequence

SEQ ID NO: 55 - protein, 30 aa, Artificial Sequence
  Description of Artificial Sequence: Synthetic Framework1 sequence
EVQLVESGGGLVQPGGSLRLSCSASGSIFG

SEQ ID NO: 56 - protein, 30 aa, Artificial Sequence
  Description of Artificial Sequence: Synthetic Framework1 sequence
EVQLVESGGGLVQPGGSLKLSCVASGSMFR

SEQ ID NO: 57 - protein, 5 aa, Artificial Sequence
  Description of Artificial Sequence: Synthetic CDR1 sequence
SYWMY

SEQ ID NO: 58 - protein, 5 aa, Artificial Sequence
  Description of Artificial Sequence: Synthetic CDR1 sequence
LNAMA

SEQ ID NO: 59 - protein, 5 aa, Artificial Sequence
  Description of Artificial Sequence: Synthetic CDR1 sequence
SAPMG

SEQ ID NO: 60 - protein, 5 aa, Artificial Sequence
  Description of Artificial Sequence: Synthetic CDR1 sequence
SYPMS

SEQ ID NO: 61 - protein, 5 aa, Artificial Sequence
  Description of Artificial Sequence: Synthetic CDR1 sequence
INAMG

SEQ ID NO: 62 - protein, 5 aa, Artificial Sequence
  Description of Artificial Sequence: Synthetic CDR1 sequence
INAMG

SEQ ID NO: 63 - protein, 5 aa, Artificial Sequence
  Description of Artificial Sequence: Synthetic CDR1 sequence
INAMA

SEQ ID NO: 64 - protein, 5 aa, Artificial Sequence
  Description of Artificial Sequence: Synthetic CDR1 sequence
DYAIG

SEQ ID NO: 65 - protein, 5 aa, Artificial Sequence
  Description of Artificial Sequence: Synthetic CDR1 sequence
SYALG

SEQ ID NO: 66 - protein, 5 aa, Artificial Sequence
  Description of Artificial Sequence: Synthetic CDR1 sequence
YYTIG

SEQ ID NO: 67 - protein, 5 aa, Artificial Sequence
  Description of Artificial Sequence: Synthetic CDR1 sequence
LNAMG

SEQ ID NO: 68 - protein, 5 aa, Artificial Sequence
  Description of Artificial Sequence: Synthetic CDR1 sequence
GYAIG

SEQ ID NO: 69 - protein, 5 aa, Artificial Sequence
  Description of Artificial Sequence: Synthetic CDR1 sequence
DYTIG

SEQ ID NO: 70 - protein, 5 aa, Artificial Sequence
  Description of Artificial Sequence: Synthetic CDR1 sequence
LNAMG

SEQ ID NO: 71 - protein, 5 aa, Artificial Sequence
  Description of Artificial Sequence: Synthetic CDR1 sequence
FYHMA

SEQ ID NO: 72 - protein, 14 aa, Artificial Sequence
  Description of Artificial Sequence: Synthetic Framework2 sequence
WVRQAPGKGVEWVS

SEQ ID NO: 73 - protein, 14 aa, Artificial Sequence
  Description of Artificial Sequence: Synthetic Framework2 sequence
WYRQAPGKERELVA

SEQ ID NO: 74 - protein, 14 aa, Artificial Sequence
  Description of Artificial Sequence: Synthetic Framework2 sequence
WYRQAPGKERELVA

SEQ ID NO: 75 - protein, 14 aa, Artificial Sequence
  Description of Artificial Sequence: Synthetic Framework2 sequence
WVRQAPGKGPAWVS

SEQ ID NO: 76 - protein, 14 aa, Artificial Sequence
  Description of Artificial Sequence: Synthetic Framework2 sequence
WYRQAPGKRRELVA

SEQ ID NO: 77 - protein, 14 aa, Artificial Sequence
  Description of Artificial Sequence: Synthetic Framework2 sequence
WYRQAPGKQRELVA

SEQ ID NO: 78 - protein, 14 aa, Artificial Sequence
  Description of Artificial Sequence: Synthetic Framework2 sequence
WYRQAPGKQRELVA

SEQ ID NO: 79 - protein, 14 aa, Artificial Sequence
  Description of Artificial Sequence: Synthetic Framework2 sequence
WFRQAPGKEREGVS

SEQ ID NO: 80 - protein, 14 aa, Artificial Sequence
  Description of Artificial Sequence: Synthetic Framework2 sequence
WFRRAPGKERECVA

SEQ ID NO: 81 - protein, 14 aa, Artificial Sequence
  Description of Artificial Sequence: Synthetic Framework2 sequence
WFRQAPGKEREGVS

SEQ ID NO: 82 - protein, 14 aa, Artificial Sequence
  Description of Artificial Sequence: Synthetic Framework2 sequence
WFRQGPGKDREFVA

SEQ ID NO: 83 - protein, 14 aa, Artificial Sequence
  Description of Artificial Sequence: Synthetic Framework2 sequence
WFRQAPGKEREGVS

SEQ ID NO: 84 - protein, 14 aa, Artificial Sequence
  Description of Artificial Sequence: Synthetic Framework2 sequence
WFRQAPGKEREEIS

SEQ ID NO: 85 - protein, 14 aa, Artificial Sequence
  Description of Artificial Sequence: Synthetic Framework2 sequence
WYRQTPGKERELVA

SEQ ID NO: 86 - protein, 14 aa, Artificial Sequence
  Description of Artificial Sequence: Synthetic Framework2 sequence
WYRQAPGEQRELVA

SEQ ID NO: 87 - protein, 16 aa, Artificial Sequence
  Description of Artificial Sequence: Synthetic CDR2 sequence
AISPGGVERYTDSVKG

SEQ ID NO: 88 - protein, 16 aa, Artificial Sequence
  Description of Artificial Sequence: Synthetic CDR2 sequence
GIFGVGSTRYADSVKG

SEQ ID NO: 89 - protein, 16 aa, Artificial Sequence
  Description of Artificial Sequence: Synthetic CDR2 sequence
YISGDERIWYGDSVKG

SEQ ID NO: 90 - protein, 17 aa, Artificial Sequence
  Description of Artificial Sequence: Synthetic CDR2 sequence
TVSPGGITTSYADSVKG

SEQ ID NO: 91 - protein, 16 aa, Artificial Sequence
  Description of Artificial Sequence: Synthetic CDR2 sequence
LITSSDTTDYAESVEG

SEQ ID NO: 92 - protein, 16 aa, Artificial Sequence
  Description of Artificial Sequence: Synthetic CDR2 sequence
LITSSDTTDYAESVEG

SEQ ID NO: 93 - protein, 16 aa, Artificial Sequence
  Description of Artificial Sequence: Synthetic CDR2 sequence
EITAGGSTNYADSVKG

SEQ ID NO: 94 - protein, 17 aa, Artificial Sequence
  Description of Artificial Sequence: Synthetic CDR2 sequence
CISSSDGSTVYADSVKG

SEQ ID NO: 95 - protein, 17 aa, Artificial Sequence
  Description of Artificial Sequence: Synthetic CDR2 sequence
ATDRLGDNTYFPDSVKG

SEQ ID NO: 96 - protein, 17 aa, Artificial Sequence
  Description of Artificial Sequence: Synthetic CDR2 sequence
CISSRDGDSYYADSVKG

SEQ ID NO: 97 - protein, 17 aa, Artificial Sequence
  Description of Artificial Sequence: Synthetic CDR2 sequence
AIDWSDGNKDYADSVKG

SEQ ID NO: 98 - protein, 17 aa, Artificial Sequence
  Description of Artificial Sequence: Synthetic CDR2 sequence
CISGGDGRSYYADSVKG

SEQ ID NO: 99 - protein, 17 aa, Artificial Sequence
  Description of Artificial Sequence: Synthetic CDR2 sequence
CISNNDGSTYYTNSVKG

SEQ ID NO: 100 - protein, 19 aa, Artificial Sequence
  Description of Artificial Sequence: Synthetic CDR2 sequence
GITSITRVGSTRYADSAKG

SEQ ID NO: 101 - protein, 16 aa, Artificial Sequence
  Description of Artificial Sequence: Synthetic CDR2 sequence
RIYTGGDTIYGDSVLG

SEQ ID NO: 102 - protein, 32 aa, Artificial Sequence
  Description of Artificial Sequence: Synthetic Framework3 sequence
RFTISRDNAKNTLYLQMNSLKSEDTAMYYCAR

SEQ ID NO: 103 - protein, 32 aa, Artificial Sequence
  Description of Artificial Sequence: Synthetic Framework3 sequence
RFTISRDIAKNTVFLQMNSLNSEDTAVYYCRM

SEQ ID NO: 104 - protein, 32 aa, Artificial Sequence
  Description of Artificial Sequence: Synthetic Framework3 sequence
RFTISRDTTKNTLYLQMNSLKPEDTAVYYCVS

SEQ ID NO: 105 - protein, 32 aa, Artificial Sequence
  Description of Artificial Sequence: Synthetic Framework3 sequence
RFTISRDNAKNTLYLQMNSLKPEDTAVYYCLR

SEQ ID NO: 106 - protein, 32 aa, Artificial Sequence
  Description of Artificial Sequence: Synthetic Framework3 sequence
RFTISRDNTWNAVYLQMNSLKPEDTAVYYCHS

SEQ ID NO: 107 - protein, 32 aa, Artificial Sequence; identical to SEQ ID NO: 106
  Description of Artificial Sequence: Synthetic Framework3 sequence

SEQ ID NO: 108 - protein, 32 aa, Artificial Sequence
  Description of Artificial Sequence: Synthetic Framework3 sequence
RFTISVDNAWNTLYLQMNSLKVEDTAVYYCNL

SEQ ID NO: 109 - protein, 32 aa, Artificial Sequence
  Description of Artificial Sequence: Synthetic Framework3 sequence
RFTISSDNAKNTVYLQMNSLKPEDTAVYYCAA

SEQ ID NO: 110 - protein, 32 aa, Artificial Sequence
  Description of Artificial Sequence: Synthetic Framework3 sequence
RFTISRDNAKNTLYLQMNNLKPEDTAVYYCAA

SEQ ID NO: 111 - protein, 32 aa, Artificial Sequence
  Description of Artificial Sequence: Synthetic Framework3 sequence
RFTISRDNAKNTAYLQMNSLKPEDTAVYYCAA

SEQ ID NO: 112 - protein, 32 aa, Artificial Sequence
  Description of Artificial Sequence: Synthetic Framework3 sequence
RFTISRDNAKNTVYLQMNSLKPEDTAVYYCAA

SEQ ID NO: 113 - protein, 32 aa, Artificial Sequence
  Description of Artificial Sequence: Synthetic Framework3 sequence
RFTVSSDNAKNTLYLEMNSLKPEDTAVYYCAV

SEQ ID NO: 114 - protein, 32 aa, Artificial Sequence; identical to SEQ ID NO: 109
  Description of Artificial Sequence: Synthetic Framework3 sequence

SEQ ID NO: 115 - protein, 32 aa, Artificial Sequence
  Description of Artificial Sequence: Synthetic Framework3 sequence
RFTISGDYAKNTVYLQMNSLKPEDTGVYYCRM

SEQ ID NO: 116 - protein, 32 aa, Artificial Sequence
  Description of Artificial Sequence: Synthetic Framework3 sequence
RFTISRDNSKNTVYLQMNTLKPEDTGVYYCNA

SEQ ID NO: 117 - protein, 7 aa, Artificial Sequence
  Description of Artificial Sequence: Synthetic CDR3 sequence
LTSFATP

SEQ ID NO: 118 - protein, 10 aa, Artificial Sequence
  Description of Artificial Sequence: Synthetic CDR3 sequence
SSVTRGSSDY

SEQ ID NO: 119 - protein, 6 aa, Artificial Sequence
  Description of Artificial Sequence: Synthetic CDR3 sequence
DVKVRH

SEQ ID NO: 120 - protein, 4 aa, Artificial Sequence
  Description of Artificial Sequence: Synthetic CDR3 sequence
DLNN

SEQ ID NO: 121 - protein, 14 aa, Artificial Sequence
  Description of Artificial Sequence: Synthetic CDR3 sequence
DHYSMGVPEKRVIM

SEQ ID NO: 122 - protein, 14 aa, Artificial Sequence
  Description of Artificial Sequence: Synthetic CDR3 sequence
DHYSMGVPEKRVIM

SEQ ID NO: 123 - protein, 12 aa, Artificial Sequence
  Description of Artificial Sequence: Synthetic CDR3 sequence
DHYTTWDRRSAY

SEQ ID NO: 124 - protein, 18 aa, Artificial Sequence
  Description of Artificial Sequence: Synthetic CDR3 sequence
ERRRGYSDLCRFYYGMDY

SEQ ID NO: 125 - protein, 16 aa, Artificial Sequence
  Description of Artificial Sequence: Synthetic CDR3 sequence
GAVRYGVSTSPMNYNY

SEQ ID NO: 126 - protein, 18 aa, Artificial Sequence
  Description of Artificial Sequence: Synthetic CDR3 sequence
SASDYGLGLELFHDEYNY

SEQ ID NO: 127 - protein, 16 aa, Artificial Sequence
  Description of Artificial Sequence: Synthetic CDR3 sequence
DTPPWGPMIYIESYDS

SEQ ID NO: 128 - protein, 18 aa, Artificial Sequence
  Description of Artificial Sequence: Synthetic CDR3 sequence
IWGPYCSDSYEYLYEYDY

SEQ ID NO: 129 - protein, 18 aa, Artificial Sequence
  Description of Artificial Sequence: Synthetic CDR3 sequence
SPHGCWYDLIPLQADFGS

SEQ ID NO: 130 - protein, 10 aa, Artificial Sequence
  Description of Artificial Sequence: Synthetic CDR3 sequence
SIVKSGGADY

SEQ ID NO: 131 - protein, 6 aa, Artificial Sequence
  Description of Artificial Sequence: Synthetic CDR3 sequence
FREYHI

SEQ ID NO: 132 - protein, 11 aa, Artificial Sequence
  Description of Artificial Sequence: Synthetic Framework4 sequence
ESQGTQVTVSS

SEQ ID NO: 133 - protein, 11 aa, Artificial Sequence
  Description of Artificial Sequence: Synthetic Framework4 sequence
WGQGTQVTVSS

SEQ ID NO: 134 - protein, 11 aa, Artificial Sequence
  Description of Artificial Sequence: Synthetic Framework4 sequence
WGQGTQVTVSS

SEQ ID NO: 135 - protein, 11 aa, Artificial Sequence
  Description of Artificial Sequence: Synthetic Framework4 sequence
RGQGTQVTVSS

SEQ ID NO: 136 - protein, 11 aa, Artificial Sequence
  Description of Artificial Sequence: Synthetic Framework4 sequence
YGQGTQVTVSS

SEQ ID NO: 137 - protein, 11 aa, Artificial Sequence
  Description of Artificial Sequence: Synthetic Framework4 sequence
YGQGTQVTVSS

SEQ ID NO: 138 - protein, 11 aa, Artificial Sequence
  Description of Artificial Sequence: Synthetic Framework4 sequence
WGQGTQVTVSS

SEQ ID NO: 139 - protein, 11 aa, Artificial Sequence
  Description of Artificial Sequence: Synthetic Framework4 sequence
WGKGTQVTVSS

SEQ ID NO: 140 - protein, 11 aa, Artificial Sequence
  Description of Artificial Sequence: Synthetic Framework4 sequence
WGQGTQVTVSS

SEQ ID NO: 141 - protein, 11 aa, Artificial Sequence
  Description of Artificial Sequence: Synthetic Framework4 sequence
WGQGTQVTVSS

SEQ ID NO: 142 - protein, 11 aa, Artificial Sequence
  Description of Artificial Sequence: Synthetic Framework4 sequence
WGQGTQVTVSS

SEQ ID NO: 143 - protein, 11 aa, Artificial Sequence
  Description of Artificial Sequence: Synthetic Framework4 sequence
WGQGTQVTVSS

SEQ ID NO: 144 - protein, 11 aa, Artificial Sequence
  Description of Artificial Sequence: Synthetic Framework4 sequence
WGQGTQVTVSS

SEQ ID NO: 145 - protein, 11 aa, Artificial Sequence
  Description of Artificial Sequence: Synthetic Framework4 sequence
WGQGTQVTVSS

SEQ ID NO: 146 - protein, 11 aa, Artificial Sequence
  Description of Artificial Sequence: Synthetic Framework4 sequence
WGQGTQVTVSS

SEQ ID NO: 147 - protein, 409 aa, Artificial Sequence
  Description of Artificial Sequence: Synthetic Nanobody sequence
EVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGGSGGGGSGGGGSGGGGSGGGGSGGGGSEVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 148 - protein, 399 aa, Artificial Sequence
  Description of Artificial Sequence: Synthetic Nanobody sequence
EVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 149 - protein, 409 aa, Artificial Sequence
  Description of Artificial Sequence: Synthetic Nanobody sequence
EVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 150 - protein, 397 aa, Artificial Sequence
  Description of Artificial Sequence: Synthetic Nanobody sequence
EVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 151 - protein, 399 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 152 - protein, 389 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 153 - protein, 399 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 154 - protein, 394 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 155 - protein, 409 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGGSGGGGSGGGGSGGGGSGGGGSGGGGSEVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 156 - protein, 399 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 157 - protein, 409 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 158 - protein, 404 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 159 - protein, 397 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 160 - protein, 394 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 161 - protein, 404 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 162 - protein, 399 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 163 - protein, 392 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 164 - protein, 397 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGGSGGGGSGGGGSGGGGSGGGGSGGGGSEVQLVESGGGLMQAGDSLRLSCAASGRAFSSYALGWFRRAPGKEREFVAATDRLGDNTYFPDSVKGRFTISRDNAKNTLYLQMNNLKPEDTAVYYCAAGAVRYGVSTSPMNYNYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 165 - protein, 397 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 166 - protein, 392 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 167 - protein, 385 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 168 - protein, 396 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 169 - protein, 406 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 170 - protein, 394 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 171 - protein, 396 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 172 - protein, 403 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 173 - protein, 406 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 174 - protein, 394 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 175 - protein, 387 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 176 - protein, 392 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 177 - protein, 395 aa, Artificial Sequence
  Description of Artificial Sequence: Synthetic Nanobody sequence
EVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTLVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 178 - protein, 406 aa, Artificial Sequence
  Description of Artificial Sequence: Synthetic Nanobody sequence
EVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 179 - protein, 404 aa, Artificial Sequence
  Description of Artificial Sequence: Synthetic Nanobody sequence
EVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 180 - protein, 402 aa, Artificial Sequence
  Description of Artificial Sequence: Synthetic Nanobody sequence
EVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 181 - protein, 405 aa, Artificial Sequence
  Description of Artificial Sequence: Synthetic Nanobody sequence
EVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 182 - protein, 387 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 183 - protein, 390 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 184 - protein, 393 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 185 - protein, 406 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGGSGGGGSGGGGSGGGGSGGGGSGGGGSEVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 186 - protein, 401 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 187 - protein, 399 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 188 - protein, 402 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 189 - protein, 402 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTQVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 190 - protein, 405 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTQVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 191 - protein, 404 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGGSGGGGSGGGGSGGGGSGGGGSGGGGSEVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 192 - protein, 401 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 193 - protein, 397 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 194 - protein, 400 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 195 - protein, 390 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 196 - protein, 402 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 197 - protein, 392 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 198 - protein, 399 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 199 - protein, 402 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 200 - protein, 397 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 201 - protein, 395 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 202 - protein, 398 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 203 - protein, 393 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 204 - protein, 405 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLMQAGDSLRLSCAASGRAFSSYALGWFRRAPGKERECVAATDRLGDNTYFPDSVKGRFTISRDNAKNTLYLQMNNLKPEDTAVYYCAAGAVRYGVSTSPMNYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 205 - protein, 395 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLVQPGGSLRLSCVASGFTFSSYWMYWVRQAPGKGVEWVSAISPGGVERYTDSVKGRFTISRDNAKNTLYLQMNSLKSEDTAMYYCARLTSFATPESQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 206 - protein, 402 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 207 - protein, 405 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 208 - protein, 400 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 209 - protein, 398 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 210 - protein, 401 aa, Artificial Sequence
  Description of Artificial Sequence: Synthetic Nanobody sequence
EVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGGSGGGGSGGGGSGGGGSGGGGSGGGGSEVQLVESGGGLVQPGGSLRLSCSASGSIFGLNAMGWYRQTPGKERELVAGITSITRVGSTRYADSAKGRFTISGDYAKNTVYLQMNSLKPEDTGVYYCRMSIVKSGGADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 211 - protein, 409 aa, Artificial Sequence; identical to SEQ ID NO: 157
  Description of Artificial Sequence: Synthetic Nanobody sequence

SEQ ID NO: 212 - protein, 404 aa, Artificial Sequence; identical to SEQ ID NO: 158
  Description of Artificial Sequence: Synthetic Nanobody sequence

SEQ ID NO: 213 - protein, 397 aa, Artificial Sequence; identical to SEQ ID NO: 159
  Description of Artificial Sequence: Synthetic Nanobody sequence

SEQ ID NO: 214 - protein, 404 aa, Artificial Sequence; identical to SEQ ID NO: 161
  Description of Artificial Sequence: Synthetic Nanobody sequence

SEQ ID NO: 215 - protein, 392 aa, Artificial Sequence; identical to SEQ ID NO: 163
  Description of Artificial Sequence: Synthetic Nanobody sequence

SEQ ID NO: 216 - protein, 397 aa, Artificial Sequence; identical to SEQ ID NO: 165
  Description of Artificial Sequence: Synthetic Nanobody sequence

SEQ ID NO: 217 - protein, 392 aa, Artificial Sequence; identical to SEQ ID NO: 166
  Description of Artificial Sequence: Synthetic Nanobody sequence

SEQ ID NO: 218 - protein, 385 aa, Artificial Sequence; identical to SEQ ID NO: 167
  Description of Artificial Sequence: Synthetic Nanobody sequence

SEQ ID NO: 219 - protein, 406 aa, Artificial Sequence; identical to SEQ ID NO: 169
  Description of Artificial Sequence: Synthetic Nanobody sequence

SEQ ID NO: 220 - protein, 394 aa, Artificial Sequence; identical to SEQ ID NO: 170
  Description of Artificial Sequence: Synthetic Nanobody sequence

SEQ ID NO: 221 - protein, 403 aa, Artificial Sequence; identical to SEQ ID NO: 172
  Description of Artificial Sequence: Synthetic Nanobody sequence

SEQ ID NO: 222 - protein, 406 aa, Artificial Sequence; identical to SEQ ID NO: 173
  Description of Artificial Sequence: Synthetic Nanobody sequence

SEQ ID NO: 223 - protein, 394 aa, Artificial Sequence; identical to SEQ ID NO: 174
  Description of Artificial Sequence: Synthetic Nanobody sequence

SEQ ID NO: 224 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLNNRGQGTLVTVSSAAAEQKLISEEDLNGAAHHHHHH

SEQ ID NO: 225 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLNNRGQGTLVTVSSAAAEQKLISEEDLNGAAHHHHHH

SEQ ID NO: 226 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCARDLNNRGQGTLVTVSSAAAEQKLISEEDLNGAAHHHHHH

SEQ ID NO: 227 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCARDLNNRGQGTLVTVSSAAAEQKLISEEDLNGAAHHHHHH

SEQ ID NO: 228 - protein, 148 aa, Artificial Sequence
  Description of Artificial Sequence: Synthetic Nanobody sequence
EVQLVESGGGLVQPGGSLRLSCAASGRTYYLNAMGWFRQGPGKDREFVAAIDWSDGNKDYADSVKGRFTISRDNSKNTVYLQMNSLRPEDTAVYYCAADTPPWGPMIYIESYDSWGQGTLVTVSSAAAEQKLISEEDLNGAAHHHHHH

SEQ ID NO: 229 - protein, 148 aa, Artificial Sequence
  Description of Artificial Sequence: Synthetic Nanobody sequence
EVQLVESGGGLVQPGGSLRLSCAASGRTYYLNAMGWFRQAPGKDREFVAAIDWSDGNKDYADSVKGRFTISRDNSKNTVYLQMNSLRPEDTAVYYCAADTPPWGPMIYIESYDSWGQGTLVTVSSAAAEQKLISEEDLNGAAHHHHHH

SEQ ID NO: 230 - protein, 148 aa, Artificial Sequence
  Description of Artificial Sequence: Synthetic Nanobody sequence
EVQLVESGGGLVQPGGSLRLSCAASGRTYYLNAMGWFRQGPGKEREFVAAIDWSDGNKDYADSVKGRFTISRDNSKNTVYLQMNSLRPEDTAVYYCAADTPPWGPMIYIESYDSWGQGTLVTVSSAAAEQKLISEEDLNGAAHHHHHH

SEQ ID NO: 231 - protein, 148 aa, Artificial Sequence
  Description of Artificial Sequence: Synthetic Nanobody sequence
EVQLVESGGGLVQPGGSLRLSCAASGRTYYLNAMGWFRQAPGKEREFVAAIDWSDGNKDYADSVKGRFTISRDNSKNTVYLQMNSLRPEDTAVYYCAADTPPWGPMIYIESYDSWGQGTLVTVSSAAAEQKLISEEDLNGAAHHHHHH

SEQ ID NO: 232 - protein, 397 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 233 - protein, 399 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 234 - protein, 397 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGGSGGGGSGGGGSGGGGSGGGGSGGGGSEVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 235 - protein, 390 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 236 - protein, 395 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 237 - protein, 390 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGGSGGGGSGGGGSGGGGSGGGGSGGGGSEVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 238 - protein, 399 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 239 - protein, 402 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGGSGGGGSGGGGSGGGGSGGGGSGGGGSEVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 240 - protein, 402 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTLVTVSSGGGGSGGGGSGGGGSGGGGSGGGGSGGGGSGGGGSEVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 241 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSGGVPEKRVIMYGQGTLVTVSSAAAEQKLISEEDLNGAAHHHHHH

SEQ ID NO: 242 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSLGVPEKRVIMYGQGTLVTVSSAAAEQKLISEEDLNGAAHHHHHH

SEQ ID NO: 243 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSIGVPEKRVIMYGQGTLVTVSSAAAEQKLISEEDLNGAAHHHHHH

SEQ ID NO: 244 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSVGVPEKRVIMYGQGTLVTVSSAAAEQKLISEEDLNGAAHHHHHH

SEQ ID NO: 245 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVILYGQGTLVTVSSAAAEQKLISEEDLNGAAHHHHHH

SEQ ID NO: 246 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIDYGQGTLVTVSSAAAEQKLISEEDLNGAAHHHHHH

SEQ ID NO: 247 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIEYGQGTLVTVSSAAAEQKLISEEDLNGAAHHHHHH

SEQ ID NO: 248 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDISKNTVFLQMNSLRSEDTAVYYCRMSSVTRGSSDYWGQGTLVTVSSAAAEQKLISEEDLNGAAHHHHHH

SEQ ID NO: 249 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDNSKNTVFLQMNSLRSEDTAVYYCRMSSVTRGSSDYWGQGTLVTVSSAAAEQKLISEEDLNGAAHHHHHH

SEQ ID NO: 250 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDISKNTVYLQMNSLRSEDTAVYYCRMSSVTRGSSDYWGQGTLVTVSSAAAEQKLISEEDLNGAAHHHHHH

SEQ ID NO: 251 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDISKNTVFLQMNSLRSEDTAVYYCAMSSVTRGSSDYWGQGTLVTVSSAAAEQKLISEEDLNGAAHHHHHH

SEQ ID NO: 252 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDNSKNTVYLQMNSLRSEDTAVYYCRMSSVTRGSSDYWGQGTLVTVSSAAAEQKLISEEDLNGAAHHHHHH

SEQ ID NO: 253 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDNSKNTVFLQMNSLRSEDTAVYYCAMSSVTRGSSDYWGQGTLVTVSSAAAEQKLISEEDLNGAAHHHHHH

SEQ ID NO: 254 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDISKNTVYLQMNSLRSEDTAVYYCAMSSVTRGSSDYWGQGTLVTVSSAAAEQKLISEEDLNGAAHHHHHH

SEQ ID NO: 255 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDNSKNTVYLQMNSLRSEDTAVYYCAMSSVTRGSSDYWGQGTLVTVSSAAAEQKLISEEDLNGAAHHHHHH

SEQ ID NO: 256 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDISKNTVFLQMNSLRPEDTAVYYCRMSSVTRGSSDYWGQGTLVTVSSAAAEQKLISEEDLNGAAHHHHHH

SEQ ID NO: 257 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDISKNTVFLQMNSLRAEDTAVYYCRMSSVTRGSSDYWGQGTLVTVSSAAAEQKLISEEDLNGAAHHHHHH

SEQ ID NO: 258 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSYGNKDYADSVKGRFTISRDNAKNTVYLQMNSLKPEDTAVYYCAADTPPWGPMIYIESYDSWGQGTLVTVSSAAAEQKLISEEDLNGAAHHHHHH

SEQ ID NO: 259 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSEGNKDYADSVKGRFTISRDNAKNTVYLQMNSLKPEDTAVYYCAADTPPWGPMIYIESYDSWGQGTLVTVSSAAAEQKLISEEDLNGAAHHHHHH

SEQ ID NO: 260 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDANKDYADSVKGRFTISRDNAKNTVYLQMNSLKPEDTAVYYCAADTPPWGPMIYIESYDSWGQGTLVTVSSAAAEQKLISEEDLNGAAHHHHHH

SEQ ID NO: 261 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPFIYIESYDSWGQGTLVTVSSAAAEQKLISEEDLNGAAHHHHHH

SEQ ID NO: 262 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPYIYIESYDSWGQGTLVTVSSAAAEQKLISEEDLNGAAHHHHHH

SEQ ID NO: 263 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPLIYIESYDSWGQGTLVTVSSAAAEQKLISEEDLNGAAHHHHHH

SEQ ID NO: 264 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYQSWGQGTLVTVSSAAAEQKLISEEDLNGAAHHHHHH

SEQ ID NO: 265 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYESWGQGTLVTVSSAAAEQKLISEEDLNGAAHHHHHH

SEQ ID NO: 266 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDDWGQGTLVTVSSAAAEQKLISEEDLNGAAHHHHHH

SEQ ID NO: 267 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDEWGQGTLVTVSSAAAEQKLISEEDLNGAAHHHHHH

SEQ ID NO: 268 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDTWGQGTLVTVSSAAAEQKLISEEDLNGAAHHHHHH

SEQ ID NO: 269 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDNSKNTVYLQMNSLRAEDTAVYYCRMSSVTRGSSDYWGQGTLVTVSSAAAEQKLISEEDLNGAAHHHHHH

SEQ ID NO: 270 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSAAAEQKLISEEDLNGAAHHHHHH

SEQ ID NO: 271 - protein, 141 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRAEDTAVYYCRMSSVTRGSSDYWGQGTLVTVSSAAAEQKLISEEDLNGAAHHHHHH

SEQ ID NO: 272 - protein, 141 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSAAAEQKLISEEDLNGAAHHHHHH

SEQ ID NO: 273 - protein, 143 aa, Artificial Sequence
  Description of Artificial Sequence: Synthetic Nanobody sequence
EVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSAAAEQKLISEEDLNGAAHHHHHH

SEQ ID NO: 274 - protein, 143 aa, Artificial Sequence
  Description of Artificial Sequence: Synthetic Nanobody sequence
EVQLVESGGGLVQPGGSLRLSCAASGSIFRINAMAWYRQAPGKQRELVAEITAGGSTNYADSVKGRFTISRDNSWNTLYLQMNSLRAEDTAVYYCNLDHYTTWDRRSAYWGQGTLVTVSSAAAEQKLISEEDLNGAAHHHHHH

SEQ ID NO: 275 - protein, 145 aa, Artificial Sequence
  Description of Artificial Sequence: Synthetic Nanobody sequence
EVQLVESGGGLVQPGGSLRLSCAASGTLFKINAMGWYRQAPGKQRELVALITSSDTTDYAEDVKGRFTISRDNSWNTVYLQMNSLRPEDTAVYYCHSDHYSLGVPEKRVILYGQGTLVTVSSAAAEQKLISEEDLNGAAHHHHHH

SEQ ID NO: 276 - protein, 143 aa, Artificial Sequence
  Description of Artificial Sequence: Synthetic Nanobody sequence
DVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSAAAEQKLISEEDLNGAAHHHHHH

SEQ ID NO: 277 - protein, 143 aa, Artificial Sequence
  Description of Artificial Sequence: Synthetic Nanobody sequence
DVQLVESGGGLVQPGGSLRLSCAASGSIFRINAMAWYRQAPGKQRELVAEITAGGSTNYADSVKGRFTISRDNSWNTLYLQMNSLRAEDTAVYYCNLDHYTTWDRRSAYWGQGTLVTVSSAAAEQKLISEEDLNGAAHHHHHH

SEQ ID NO: 278 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSAAAEQKLISEEDLNGAAHHHHHH

SEQ ID NO: 279 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSSAAAEQKLISEEDLNGAAHHHHHH

SEQ ID NO: 280 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLSNRGQGTLVTVSSAAAEQKLISEEDLNGAAHHHHHH

SEQ ID NO: 281 - protein, 136 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLSNRGQGTLVTVSSAAAEQKLISEEDLNGAAHHHHHH

SEQ ID NO: 282 - protein, 376 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSS

SEQ ID NO: 283 - protein, 428 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSS

SEQ ID NO: 284 - protein, 376 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 285 - protein, 428 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGGSGGGGSGGGGSGGGGSGGGGSGGGGSEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 286 - protein, 371 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSS

SEQ ID NO: 287 - protein, 423 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSS

SEQ ID NO: 288 - protein, 371 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 289 - protein, 423 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGGSGGGGSGGGGSGGGGSGGGGSGGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 290 - protein, 373 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSS

SEQ ID NO: 291 - protein, 425 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSS

SEQ ID NO: 292 - protein, 373 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 293 - protein, 425 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 294 - protein, 418 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSS

SEQ ID NO: 295 - protein, 418 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSS

SEQ ID NO: 296 - protein, 418 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 297 - protein, 418 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 298 - protein, 418 aa, Artificial Sequence
  Description of Artificial Sequence: Synthetic Nanobody sequence
DVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSS

SEQ ID NO: 299 - protein, 418 aa, Artificial Sequence
  Description of Artificial Sequence: Synthetic Nanobody sequence
DVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSS

SEQ ID NO: 300 - protein, 418 aa, Artificial Sequence
  Description of Artificial Sequence: Synthetic Nanobody sequence
DVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGGSGGGGSGGGGSGGGGSGGGGSGGGGSEVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 301 - protein, 418 aa, Artificial Sequence
  Description of Artificial Sequence: Synthetic Nanobody sequence
DVQLVESGGGLVQPGGSLRLSCAASGSIFRINAMAWYRQAPGKQRELVAEITAGGSTNYADSVKGRFTISRDNSWNTLYLQMNSLRPEDTAVYYCNLDHYTTWDRRSAYWGQGTLVTVSSGGGGSGGGGSGGGGSGGGGSGGGGSGGGGSGGGGSEVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 302 - protein, 420 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSS

SEQ ID NO: 303 - protein, 420 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSS

SEQ ID NO: 304 - protein, 420 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 305 - protein, 420 aa, Artificial Sequence
  Description of Artificial Sequence: Synthetic Nanobody sequence
EVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 306 - protein, 420 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSS

SEQ ID NO: 307 - protein, 420 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSS

SEQ ID NO: 308 - protein, 420 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGGSGGGGSGGGGSGGGGSGGGGSGGGGSEVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 309 - protein, 420 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGGSGGGGSGGGGSGGGGSGGGGSGGGGSEVQLVESGGGLVQPGGSLRLSCAASGFTFSSYPMSWVRQAPGKGPAWVSTVSPGGITTSYADSVKGRFTISRDNSKNTLYLQMNSLRPEDTAVYYCLRDLGNRGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 310 - protein, 380 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYYLNAMGWFRQAPGKEREFVAAIDWSEGNKDYADSVKGRFTISRDASKNTVYLQMNSLRPEDTAVYYCAADTPPWGPLIYIESYDSWGQGTLVTVSS

SEQ ID NO: 311 - protein, 380 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGSEVQLVESGGGLVQPGGSLRLSCAASGRTYYLNAMGWFRQAPGKEREFVAAIDWSEGNKDYADSVKGRFTISRDASKNTVYLQMNSLRPEDTAVYYCAADTPPWGPLIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 312 - protein, 380 aa, Artificial Sequence
  Description of Artificial Sequence: Synthetic Nanobody sequence
EVQLVESGGGLVQPGGSLRLSCAASGRTYYLNAMGWFRQAPGKEREFVAAIDWSEGNKDYADSVKGRFTISRDASKNTVYLQMNSLRPEDTAVYYCAADTPPWGPLIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSS

SEQ ID NO: 313 - protein, 380 aa, Artificial Sequence
  Description of Artificial Sequence: Synthetic Nanobody sequence
EVQLVESGGGLVQPGGSLRLSCAASGRTYYLNAMGWFRQAPGKEREFVAAIDWSEGNKDYADSVKGRFTISRDASKNTVYLQMNSLRPEDTAVYYCAADTPPWGPLIYIESYDSWGQGTLVTVSSGGGGSGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 314 - protein, 373 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSS

SEQ ID NO: 315 - protein, 368 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSS

SEQ ID NO: 316 - protein, 242 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 317 - protein, 380 aa, Artificial Sequence
  Description of Artificial Sequence: Synthetic Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGTLFKINAMGWYRQAPGKRRELVALITSSDTTDYAEDVKGRFTISRDNSWNTVYLQMNSLRPEDTAVYYCHSDHYSLGVPEKRVILYGQGTLVTVSS

SEQ ID NO: 318 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYADSVKGRFTISRDNSWNTVYLQMNSLRPEDTAVYYCHSDHYSLGVPEKRVILYGQGTLVTVSSAAAEQKLISEEDLNGAAHHHHHH

SEQ ID NO: 319 - protein, 373 aa, Artificial Sequence
  Description of Artificial Sequence: Synthetic Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGTLFKINAMGWYRQAPGKRRELVALITSSDTTDYADSVKGRFTISRDNSWNTVYLQMNSLRPEDTAVYYCHSDHYSLGVPEKRVILYGQGTLVTVSS

SEQ ID NO: 320 - protein, 368 aa, Artificial Sequence
  Description of Artificial Sequence: Synthetic Nanobody sequence
EVQLVESGGGLVQPGGSLRLSCAASGFTFSSYPMSWVRQAPGKGPEWVSTVSPGGITTSYADSVKGRFTISRDNSKNTLYLQMNSLRPEDTAVYYCLRDLGNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGTLFKINAMGWYRQAPGKRRELVALITSSDTTDYADSVKGRFTISRDNSWNTVYLQMNSLRPEDTAVYYCHSDHYSLGVPEKRVILYGQGTLVTVSS

SEQ ID NO: 321 - protein, 380 aa, Artificial Sequence
  Description of Artificial Sequence: Synthetic Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGTLFKINAMGWYRQAPGKRRELVALITSSDTTDYADSVKGRFTISRDNSWNTVYLQMNSLRPEDTAVYYCHSDHYSLGVPEKRVILYGQGTLVTVSS

SEQ ID NO: 322 - protein, 373 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYADSVKGRFTISRDNSWNTVYLQMNSLRPEDTAVYYCHSDHYSLGVPEKRVILYGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSS

SEQ ID NO: 323 - protein, 136 aa, Artificial Sequence
  Description of Artificial Sequence: Synthetic Nanobody sequence
EVQLVESGGGLVQAGGSLRLSCAASGFTFSSYPMSWVRQAPGKGPAWVSTVSPGGITTSYADSVKGRFTISRDNAKNTLYLQMNSLKPEDTAVYYCLRDLNNRGQGTQVTVSSAAAEQKLISEEDLNGAAHHHHHH

SEQ ID NO: 324 - protein, 141 aa, Artificial Sequence
  Description of Artificial Sequence: Synthetic Nanobody sequence
EVQLVESGGGLVQPGGSLRLSCAASGSIGGLNAMAWYRQAPGKERELVAGIFGVGSTRYADSVKGRFTISRDIAKNTVFLQMNSLNSEDTAVYYCRMSSVTRGSSDYWGQGTQVTVSSAAAEQKLISEEDLNGAAHHHHHH

SEQ ID NO: 325 - protein, 145 aa, Artificial Sequence
  Description of Artificial Sequence: Synthetic Nanobody sequence
EVQLVESGGGLVQPGGSLRLSCAASGTLFKINAMGWYRQAPGKRRELVALITSSDTTDYAESVEGRFTISRDNTWNAVYLQMNSLKPEDTAVYYCHSDHYSMGVPEKRVIMYGQGTQVTVSSAAAEQKLISEEDLNGAAHHHHHH

SEQ ID NO: 326 - protein, 148 aa, Artificial Sequence
  Description of Artificial Sequence: Synthetic Nanobody sequence
EVQLVESGGGLVQAGGSLRLSCAASGRTYYLNAMGWFRQGPGKDREFVAAIDWSDGNKDYADSVKGRFTISRDNAKNTVYLQMNSLKPEDTAVYYCAADTPPWGPMIYIESYDSWGQGTQVTVSSAAAEQKLISEEDLNGAAHHHHHH

SEQ ID NO: 327 - protein, 143 aa, Artificial Sequence
  Description of Artificial Sequence: Synthetic Nanobody sequence
EVQLVESGGGLVQPGGSLGLSCVASGSIFRINAMAWYRQAPGKQRELVAEITAGGSTNYADSVKGRFTISVDNAWNTLYLQMNSLKVEDTAVYYCNLDHYTTWDRRSAYWGQGTQVTVSSAAAEQKLISEEDLNGAAHHHHHH

SEQ ID NO: 328 - DNA, 1482 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 329 - DNA, 1467 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 330 - DNA, 1446 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 331 - DNA, 1467 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 332 - DNA, 1431 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 333 - DNA, 1446 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 334 - DNA, 1431 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 335 - DNA, 1410 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 336 - DNA, 1473 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 337 - DNA, 1437 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 338 - DNA, 1464 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 339 - DNA, 1473 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 340 - DNA, 1437 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 341 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagtctgcgtctgagctgtgcagcaagcggttttacctttagcagctatccgatgagctgggttcgtcaggcaccgggtaaaggtccggcatgggttagcaccgttagtccgggaggtattaccaccagttatgcagatagcgttaaaggtcgttttaccattagccgtgacaatagcaaaaacaccctgtatctgcagatgaatagcctgcgtcctgaagataccgcagtttattattgtctgcgcgatctgaataatcgtggtcaggggaccctggtcaccgtctcctcagcggccgcagaacaaaaactcatctcagaagaggatctgaatggggccgcacatcatcatcatcatcat

SEQ ID NO: 342 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggaggtattaccaccagttatgcagatagcgttaaaggtcgttttaccattagccgtgacaatagcaaaaacaccctgtatctgcagatgaatagtctgcgtcctgaagataccgcagtttattattgtctgcgcgatctgaataatcgtggtcaggggaccctggtcaccgtctcctcagcggccgcagaacaaaaactcatctcagaagaggatctgaatggggccgcacatcatcatcatcatcat

SEQ ID NO: 343 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagtctgcgtctgagctgtgcagcaagcggttttacctttagcagctatccgatgagctgggttcgtcaggcaccgggtaaaggtccggcatgggttagcaccgttagtccgggaggtattaccaccagttatgcagatagcgttaaaggtcgttttaccattagccgtgacaatagcaaaaacaccctgtatctgcagatgaatagcctgcgtcctgaagataccgcagtttattattgtgcacgcgatctgaataatcgtggtcaggggaccctggtcaccgtctcctcagcggccgcagaacaaaaactcatctcagaagaggatctgaatggggccgcacatcatcatcatcatcat

SEQ ID NO: 344 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagtctgcgtctgagctgtgcagcaagcggttttacctttagcagctatccgatgagctgggttcgtcaggcaccgggtaaaggtcctgaatgggttagcaccgttagtccgggaggtattaccaccagttatgcagatagcgttaaaggtcgttttaccattagccgtgacaatagcaaaaacaccctgtatctgcagatgaatagcctgcgtcctgaagataccgcagtttattattgtgcacgcgatctgaataatcgtggtcaggggaccctggtcaccgtctcctcagcggccgcagaacaaaaactcatctcagaagaggatctgaatggggccgcacatcatcatcatcatcat

SEQ ID NO: 345 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtcgtacctattatctgaatgcaatgggttggtttcgtcagggtccgggtaaagatcgtgaatttgttgcagccattgattggagtgatggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgatgatttatattgaaagctatgatagctggggtcaggggaccctggtcaccgtctcctcagcggccgcagaacaaaaactcatctcagaagaggatctgaatggggccgcacatcatcatcatcatcat

SEQ ID NO: 346 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtcgtacctattatctgaatgcaatgggttggtttcgtcaggcaccgggtaaagatcgtgaatttgttgcagccattgattggagtgatggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgatgatttatattgaaagctatgatagctggggtcaggggaccctggtcaccgtctcctcagcggccgcagaacaaaaactcatctcagaagaggatctgaatggggccgcacatcatcatcatcatcat

SEQ ID NO: 347 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtcgtacctattatctgaatgcaatgggttggtttcgtcagggtccgggtaaagaacgtgaatttgttgcagccattgattggagtgatggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgatgatttatattgaaagctatgatagctggggtcaggggaccctggtcaccgtctcctcagcggccgcagaacaaaaactcatctcagaagaggatctgaatggggccgcacatcatcatcatcatcat

SEQ ID NO: 348 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagtgatggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgatgatttatattgaaagctatgatagctggggtcaggggaccctggtcaccgtctcctcagcggccgcagaacaaaaactcatctcagaagaggatctgaatggggccgcacatcatcatcatcatcat

SEQ ID NO: 349 - DNA, 1446 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 350 - DNA, 1452 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 351 - DNA, 1446 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 352 - DNA, 1425 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 353 - DNA, 1440 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 354 - DNA, 1425 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 355 - DNA, 1452 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 356 - DNA, 1461 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 357 - DNA, 1461 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcacggtctcgagcggagggggaggtagtgggggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacagggtaccctggtcaccgtctcctca

SEQ ID NO: 358 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgggtggtgtgcctgaaaagcgagtcataatgtacggccaggggaccctggtcaccgtctcctcagcggccgcagaacaaaaactcatctcagaagaggatctgaatggggccgcacatcatcatcatcatcat

SEQ ID NO: 359 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgttgggtgtgcctgaaaagcgagtcataatgtacggccaggggaccctggtcaccgtctcctcagcggccgcagaacaaaaactcatctcagaagaggatctgaatggggccgcacatcatcatcatcatcat

SEQ ID NO: 360 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgattggtgtgcctgaaaagcgagtcataatgtacggccaggggaccctggtcaccgtctcctcagcggccgcagaacaaaaactcatctcagaagaggatctgaatggggccgcacatcatcatcatcatcat

SEQ ID NO: 361 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcggttggtgtgcctgaaaagcgagtcataatgtacggccaggggaccctggtcaccgtctcctcagcggccgcagaacaaaaactcatctcagaagaggatctgaatggggccgcacatcatcatcatcatcat

SEQ ID NO: 362 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcatactgtacggccaggggaccctggtcaccgtctcctcagcggccgcagaacaaaaactcatctcagaagaggatctgaatggggccgcacatcatcatcatcatcat

SEQ ID NO: 363 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcatagattacggccaggggaccctggtcaccgtctcctcagcggccgcagaacaaaaactcatctcagaagaggatctgaatggggccgcacatcatcatcatcatcat

SEQ ID NO: 364 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcatagagtacggccaggggaccctggtcaccgtctcctcagcggccgcagaacaaaaactcatctcagaagaggatctgaatggggccgcacatcatcatcatcatcat

SEQ ID NO: 365 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggcctggttcagccgggtggtagcctgcgtctgtcttgcgcggctagcggtagcattggcggcctgaacgcgatggcatggtaccgccaagcaccgggtaaagagcgcgaattggttgccggcatctttggcgtcggtagcacccgttacgcggacagcgtcaaaggtcgtttcaccatttcgcgcgatatctccaagaataccgttttcctgcaaatgaacagcctgcgtagcgaggacacggcggtgtactattgtcgtatgagctccgtgacgcgtggtagcagcgattattggggccaggggaccctggtcaccgtctcctcagcggccgcagaacaaaaactcatctcagaagaggatctgaatggggccgcacatcatcatcatcatcat

SEQ ID NO: 366 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgataatagcaaaaataccgtgtttctgcagatgaatagcctgcgtagcgaagataccgcagtttattattgtcgtatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 367 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgatattagcaaaaataccgtgtatctgcagatgaatagcctgcgtagcgaagataccgcagtttattattgtcgtatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 368 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggcctggttcaaccgggtggtagcctgcgcctgtcctgcgcagcttcgggtagcattggtggcttgaatgccatggcgtggtaccgtcaggcaccgggtaaagagcgtgaactggtggccggcatcttcggcgttggtagcacgcgctatgcggactccgtgaagggccgtttcaccattagccgtgacatcagcaaaaacaccgtttttctgcagatgaacagcctgcgtagcgaggatacggcggtctactactgtgcgatgagctctgtcacccgcggtagcagcgattattggggccaagggaccctggtcaccgtctcctcagcggccgcagaacaaaaactcatctcagaagaggatctgaatggggccgcacatcatcatcatcatcat

SEQ ID NO: 369 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgataatagcaaaaataccgtgtatctgcagatgaatagcctgcgtagcgaagataccgcagtttattattgtcgtatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 370 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgataatagcaaaaataccgtgtttctgcagatgaatagcctgcgtagcgaagataccgcagtttattattgtgcaatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 371 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgatattagcaaaaataccgtgtatctgcagatgaatagcctgcgtagcgaagataccgcagtttattattgtgcaatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 372 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggcctggttcaaccgggtggtagcctgcgcctgagctgcgcagcgagcggtagcattggcggcctgaacgcgatggcctggtatcgccaggcaccgggcaaagagcgtgaattggttgccggcatctttggtgtgggcagcacccgttacgctgactctgtcaaaggtcgcttcacgatcagccgtgataacagcaagaataccgtgtacctgcaaatgaattcgctgcgtagcgaggacacggcggtttactattgtgcgatgtccagcgtcacccgtggttccagcgattattggggtcaggggaccctggtcaccgtctcctcagcggccgcagaacaaaaactcatctcagaagaggatctgaatggggccgcacatcatcatcatcatcat

SEQ ID NO: 373 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgatattagcaaaaataccgtgtttctgcagatgaatagcctgcgtccagaagataccgcagtttattattgtcgtatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 374 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgatattagcaaaaataccgtgtttctgcagatgaatagcctgcgtgcggaagataccgcagtttattattgtcgtatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 375 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagttatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcaccgtctcctcagcggccgcagaacaaaaactcatctcagaagaggatctgaatggggccgcacatcatcatcatcatcat

SEQ ID NO: 376 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgagggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcaccgtctcctcagcggccgcagaacaaaaactcatctcagaagaggatctgaatggggccgcacatcatcatcatcatcat

SEQ ID NO: 377 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatgcgaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggaccctggtcaccgtctcctcagcggccgcagaacaaaaactcatctcagaagaggatctgaatggggccgcacatcatcatcatcatcat

SEQ ID NO: 378 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggccttttatctacatcgaatcgtatgactcctggggccaggggaccctggtcaccgtctcctcagcggccgcagaacaaaaactcatctcagaagaggatctgaatggggccgcacatcatcatcatcatcat

SEQ ID NO: 379 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggccttatatctacatcgaatcgtatgactcctggggccaggggaccctggtcaccgtctcctcagcggccgcagaacaaaaactcatctcagaagaggatctgaatggggccgcacatcatcatcatcatcat

SEQ ID NO: 380 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctcttatctacatcgaatcgtatgactcctggggccaggggaccctggtcaccgtctcctcagcggccgcagaacaaaaactcatctcagaagaggatctgaatggggccgcacatcatcatcatcatcat

SEQ ID NO: 381 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatcagtcctggggccaggggaccctggtcaccgtctcctcagcggccgcagaacaaaaactcatctcagaagaggatctgaatggggccgcacatcatcatcatcatcat

SEQ ID NO: 382 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgagtcctggggccaggggaccctggtcaccgtctcctcagcggccgcagaacaaaaactcatctcagaagaggatctgaatggggccgcacatcatcatcatcatcat

SEQ ID NO: 383 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgacgattggggccaggggaccctggtcaccgtctcctcagcggccgcagaacaaaaactcatctcagaagaggatctgaatggggccgcacatcatcatcatcatcat

SEQ ID NO: 384 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgacgagtggggccaggggaccctggtcaccgtctcctcagcggccgcagaacaaaaactcatctcagaagaggatctgaatggggccgcacatcatcatcatcatcat

SEQ ID NO: 385 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgacacgtggggccaggggaccctggtcaccgtctcctcagcggccgcagaacaaaaactcatctcagaagaggatctgaatggggccgcacatcatcatcatcatcat

SEQ ID NO: 386 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtgcagaagataccgcagtttattattgtcgcatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 387 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 388 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtgcagaagataccgcagtttattattgtcgcatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 389 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcaccgtctcctcagcggccgcagaacaaaaactcatctcagaagaggatctgaatggggccgcacatcatcatcatcatcat

SEQ ID NO: 390 - DNA, 492 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcaccgtctcctcagcggccgcagaacaaaaactcatctcagaagaggatctgaatggggccgcacatcatcatcatcatcat

SEQ ID NO: 391 - DNA, 492 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtgcagaagataccgcagtttattattgcaacctggatcattataccacctgggatcgtcgtagcgcatattggggtcaggggaccctggtcaccgtctcctcagcggccgcagaacaaaaactcatctcagaagaggatctgaatggggccgcacatcatcatcatcatcat

SEQ ID NO: 392 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggcaccctgtttaaaattaatgcaatgggttggtatcgccaggcaccgggtaaacagcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctcagcggccgcagaacaaaaactcatctcagaagaggatctgaatggggccgcacatcatcatcatcatcat

SEQ ID NO: 393 - DNA, 492 bp, Artificial Sequence
  Description of Artificial Sequence: Synthetic Nanobody sequence
atgaaaaagaccgctatcgcgattgcagtggcactggctggtttggccaccgtggcccaggccgacgtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcaccgtctcctcagcggccgcagaacaaaaactcatctcagaagaggatctgaatggggccgcacatcatcatcatcatcat

SEQ ID NO: 394 - DNA, 492 bp, Artificial Sequence
  Description of Artificial Sequence: Synthetic Nanobody sequence
atgaaaaagaccgctatcgcgattgcagtggcactggctggtttggccaccgtggcccaggccgacgtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtgcagaagataccgcagtttattattgcaacctggatcattataccacctgggatcgtcgtagcgcatattggggtcaggggaccctggtcaccgtctcctcagcggccgcagaacaaaaactcatctcagaagaggatctgaatggggccgcacatcatcatcatcatcat

SEQ ID NO: 395 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcaccgtctcctcagcggccgcagaacaaaaactcatctcagaagaggatctgaatggggccgcacatcatcatcatcatcat

SEQ ID NO: 396 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcaccgtctcctcagcggccgcagaacaaaaactcatctcagaagaggatctgaatggggccgcacatcatcatcatcatcat

SEQ ID NO: 397 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgagcaatcgtggtcaggggaccctggtcaccgtctcctcagcggccgcagaacaaaaactcatctcagaagaggatctgaatggggccgcacatcatcatcatcatcat

SEQ ID NO: 398 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggttctctgcgtctgagctgtgcagcaagcggttttacctttagcagctatccgatgagctgggttcgtcaggcaccgggtaaaggtccggcatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgagcaatcgtggtcaggggaccctggtcaccgtctcctcagcggccgcagaacaaaaactcatctcagaagaggatctgaatggggccgcacatcatcatcatcatcat

SEQ ID NO: 399 - DNA, 1383 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcaccgtctcctca

SEQ ID NO: 400 - DNA, 1539 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcaccgtctcctca

SEQ ID NO: 401 - DNA, 1383 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcacggtctcctcaggaggtggcgggtccggaggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 402 - DNA, 1539 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 403 - DNA, 1368 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcaccgtctcctca

SEQ ID NO: 404 - DNA, 1524 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcaccgtctcctca

SEQ ID NO: 405 - DNA, 1368 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcctcaggaggtggcgggtccggaggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 406 - DNA, 1524 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 407 - DNA, 1374 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 408 - DNA, 1530 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 409 - DNA, 1374 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctcaggaggtggcgggtccggaggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 410 - DNA, 1530 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 411 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcaccgtctcctca

SEQ ID NO: 412 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcaccgtctcctca

SEQ ID NO: 413 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 414 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 415 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcaccgtctcctca

SEQ ID NO: 416 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcaccgtctcctca

SEQ ID NO: 417 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 418 - DNA, 1509 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcatttttcgtattaatgcaatggcatggtatcgtcaggcaccgggtaaacagcgtgaactggttgcagaaattaccgcaggcggtagcaccaattatgcagatagcgttaaaggtcgctttaccattagccgtgataatagctggaataccctgtatctgcagatgaatagcctgcgtcctgaagataccgcagtttattattgcaacctggatcattataccacctgggatcgtcgtagcgcatattggggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 419 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 420 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 421 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 422 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 423 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcaccgtctcctca

SEQ ID NO: 424 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcaccgtctcctca

SEQ ID NO: 425 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 426 - DNA, 1515 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctccggaggcggtgggtcaggtggcggaggcagcggtggaggaggtagtggcggtggcggtagtgggggtggaggcagcggaggcggaggcagtgggggcggtggatccgaggtgcagttggtggagtctgggggtggtctggttcagcctggtggtagcctgcgtctgagctgtgcagcaagcggttttacctttagcagctatccgatgagctgggttcgtcaggcaccgggtaaaggtccggcatgggttagcaccgttagtccgggtggtattacaaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcgagcggaggcggtgggtcaggtggcggaggcagcggtggaggaggtagtggcggtggcggtagtgggggtggaggcagcggaggcggaggcagtgggggcggtggctcagaggtacaactagtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 427 - DNA, 1395 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgatgctagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcaccgtctcctca

SEQ ID NO: 428 - DNA, 1395 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctcaggaggtggcggatccggcggaggtagtgaggtgcagctggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgatgctagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcacggtctcctcaggaggtggcgggtccggaggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 429 - DNA, 1395 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgatgctagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 430 - DNA, 1395 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgatgctagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcacggtctcctcaggaggtggcggatccggcggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctcaggaggtggcgggtccggaggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 431 - DNA, 1374 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcaccgtctcctca

SEQ ID NO: 432 - DNA, 1359 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 433 - DNA, 981 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcaccgtctcctca

SEQ ID NO: 434 - DNA, 1395 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagaagatgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 435 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagatagcgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctcagcggccgcagaacaaaaactcatctcagaagaggatctgaatggggccgcacatcatcatcatcatcat

SEQ ID NO: 436 - DNA, 1374 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagacgtgcaattggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagatagcgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 437 - DNA, 1359 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggttttacctttagcagctatccgatgagctgggttcgtcaggcaccgggtaaaggtcctgaatgggttagcaccgttagtccgggtggaattaccaccagttatgcagatagcgttaaaggtcgttttaccattagccgtgataatagcaaaaataccctgtatctgcagatgaatagcctgcgtcctgaagataccgcagtttattattgtctgcgtgatctgggtaatcgtggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagatagcgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 438 - DNA, 1395 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggtcgtacctattatctgaatgcaatgggttggtttcgtcaggcaccgggtaaagaacgtgaatttgttgcagccattgattggagcgaaggcaataaagattatgccgatagcgtgaaaggtcgttttaccattagccgtgataacagcaaaaacaccgtttatctgcagatgaatagcctgcgtcctgaagataccgcagtttattattgtgcagcagatacccctccgtggggtccgctgatttatattgaaagctatgatagctggggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagatagcgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcaccgtctcctca

SEQ ID NO: 439 - DNA, 1374 bp, Artificial Sequence
  Description of Artificial Sequence: Synthetic Nanobody sequence
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgaaaagagagaggtgcaattggtggagtctgggggtggtctggttcagcctggtggtagcctgcgtctgagctgtgcagcaagcggcaccctgtttaaaattaatgcaatgggttggtatcgccaggcaccgggtaaacgtcgtgaactggttgcactgattaccagcagcgataccaccgattatgcagatagcgttaaaggtcgctttaccattagccgtgataatagctggaataccgtttatctgcagatgaatagcctgcgtcctgaagataccgcagtttattattgtcacagcgatcattatagcctgggtgtgccggaaaaacgtgttattctgtatggtcaggggaccctggtcacggtctcctcaggaggtggcggatccggcggaggtagtgaggtgcagctggtggagtctgggggtggcttggtgcaaccgggtaacagtctgcgccttagctgcgcagcgtctggctttaccttcagctcctttggcatgagctgggttcgccaggctccgggaaaaggactggaatgggtttcgtctattagcggcagtggtagcgatacgctctacgcggactccgtgaagggccgtttcaccatctcccgcgataacgccaaaactacactgtatctgcaaatgaatagcctgcgtcctgaagacacggccgtttattactgtactattggtggctcgttaagccgttcttcacaggggaccctggtcacggtctcctcaggaggtggcgggtccggaggaggtagtgaggtgcagctggtggagtctgggggtggtctggttcagcctggtggtagcctgcgtctgagctgtgcagcaagcggtagcattggtggtctgaatgcaatggcatggtatcgtcaggcaccgggtaaagaacgtgaactggttgcaggtatttttggtgttggtagcacccgttatgcagatagcgttaaaggtcgttttaccattagccgtgacaatagcaaaaacaccgtttatctgcagatgaatagcctgcgtcctgaagataccgcagtttattattgtcgcatgagcagcgttacccgtggtagcagcgattattggggtcaggggaccctggtcaccgtctcctca

SEQ ID NO: 440 - DNA, 471 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcaggctggggggtctctgagactctcctgtgcagcctctggattcaccttcagtagctatcccatgagctgggtccgccaggctccaggaaaggggcccgcgtgggtctcaactgttagtcctggtggtataaccacaagctatgcagactccgtgaagggccgattcaccatctccagagacaacgccaagaacacgctgtatttgcaaatgaacagcctgaaacctgaggacacggccgtgtattactgcttaagagatctgaataataggggccaggggacccaggtcaccgtctcctcagcggccgcagaacaaaaactcatctcagaagaggatctgaatggggccgcacatcatcatcatcatcat

SEQ ID NO: 441 - DNA, 486 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcaacctggggggtctctgagactctcctgcgcagcctctggaagcatcggcggtctcaatgccatggcctggtaccgccaggctccaggaaaagagcgcgagttggtcgcaggtatttttggcgttggtagcacgaggtacgcggactccgtgaagggccgattcaccatctctagagacatcgccaagaacacggtgtttctgcaaatgaacagcctgaattctgaggacacggccgtttattactgtcggatgtcaagtgttactcgtggtagttctgactactggggtcaggggacccaggtcaccgtctcctcagcggccgcagaacaaaaactcatctcagaagaggatctgaatggggccgcacatcatcatcatcatcat

SEQ ID NO: 442 - DNA, 498 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgagactctcctgtgcagcctctggaacgctcttcaaaatcaacgccatgggctggtaccgccaggctccagggaagcggcgcgagttggtcgcacttattactagtagcgatacaacggattatgcagagtccgtggagggccgattcaccatctccagagacaacacgtggaacgcggtgtatctgcaaatgaacagtctgaaacctgaggatacggccgtctattactgtcactcagatcattactcgatgggtgtgcctgaaaagcgagtcataatgtacggccaggggacccaggtcaccgtctcctcagcggccgcagaacaaaaactcatctcagaagaggatctgaatggggccgcacatcatcatcatcatcat

SEQ ID NO: 443 - DNA, 507 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggattggtgcaggctgggggctctctgagactctcctgtgcagcctctggacgcacgtactatctcaatgccatgggctggttccgccagggtccagggaaggaccgtgagtttgtagcagctatagactggagtgatggtaacaaagactatgcagactccgtgaagggccgattcaccatctccagagacaacgccaagaacacggtgtatctgcaaatgaacagcctgaaacctgaggacacggccgtttattactgtgcagccgacacaccaccctgggggcctatgatctacatcgaatcgtatgactcctggggccaggggacccaggtcaccgtctcctcagcggccgcagaacaaaaactcatctcagaagaggatctgaatggggccgcacatcatcatcatcatcat

SEQ ID NO: 444 - DNA, 492 bp, Artificial Sequence
  Description of Artificial Sequence: Synthetic Nanobody sequence
atgaaaaagaccgctatcgcgattgcagtggcactggctggtttggccaccgtggcccaggccgaggtgcaattggtggagtctgggggaggcttggtgcagcctggggggtctctgggactctcctgtgtagcctctggaagcatcttcagaatcaatgccatggcctggtaccgccaggctccagggaagcagcgcgagttggtcgcggaaattactgctggtggtagcacaaactatgcagactccgtgaagggccgattcaccatctccgtagacaacgcctggaacacgctgtatctgcaaatgaacagcctgaaagttgaggacacggccgtctattactgtaatctagatcattatacgacatgggatagacggagtgcctactggggccaggggacccaggtcaccgtctcctcagcggccgcagaacaaaaactcatctcagaagaggatctgaatggggccgcacatcatcatcatcatcat

SEQ ID NO: 445 - protein, 17 aa, Artificial Sequence
  Description of Artificial Sequence: Synthetic CDR2 sequence
AIDWSEGNKDYADSVKG

SEQ ID NO: 446 - protein, 16 aa, Artificial Sequence
  Description of Artificial Sequence: Synthetic CDR3 sequence
DTPPWGPLIYIESYDS

The invention claimed is:

1. A protein or polypeptide comprising at least two immunoglobulin single variable (ISV) domains that are each directed to and/or that can each specifically bind to human HER3 (SEQ ID NO: 1), in which each such ISV domain is independently:
   (a) capable of inhibiting or blocking binding of HRG to HER-3; and/or
   (b) capable of inhibiting or blocking heterodimerization of HER-3; and/or
   (c) capable of binding to domain II of HER-3,
   wherein said protein or polypeptide comprises:
      (i) an ISV that is a 17B05-like sequence comprising:
         (A) a CDR1 comprising the amino acid sequence LNAMA (SEQ ID NO: 58);
         (B) a CDR2 comprising the amino acid sequence GIFGVGSTRYADSVKG (SEQ ID NO: 88); and
         (C) a CDR3 comprising the amino acid sequence SSVTRGSSDY (SEQ ID NO: 118); and
      (ii) an ISV that is a 21F06-like sequence comprising:
         (A) a CDR1 comprising the amino acid sequence LNAMG (SEQ ID NO: 67);
         (B) a CDR2 comprising the amino acid sequence AIDWSDGNKDYADSVKG (SEQ ID NO: 97) or AIDWSEGNKDYADSVKG (SEQ ID NO: 445); and
         (C) a CDR3 comprising the amino acid sequence DTPPWGPMIYIESYDS (SEQ ID NO: 127) or DTPPWGPLIYIESYDS (SEQ ID NO: 446).

2. The protein or polypeptide according to claim 1, further functionalized to have an increased half-life, for example by functionalisation and/or by including in the protein or polypeptide a moiety or binding unit that increases the half-life of the construct.

3. The protein or polypeptide according to claim 2, wherein the functionalization comprises (i) including a moiety or binding unit; and/or (ii) including a peptide or binding unit that can bind to a serum protein.

4. The protein or polypeptide according to claim 1, comprising an ISV domain directed to human serum albumin.

5. The protein or polypeptide according to claim 1, selected from the group consisting of SEQ ID NO:282 and SEQ ID NO:199.

6. A pharmaceutical composition comprising a protein or polypeptide or ISV according to claim 1.

7. The protein or polypeptide according to claim 1, wherein said 17B05-like sequence is SEQ ID NO: 13, optionally, with one or more of the amino acid residues at positions 11, 37, 44, 47, 83, 84, 103, 104 and 108 according to the Kabat numbering chosen from the Hallmark residues mentioned in the following table:

| Position | Human VH$_3$ | Hallmark Residues |
|---|---|---|
| 11 | L, V | L, S, V, M, W, F, T, Q, E, A, R, G, K, Y, N, P, I |
| 37 | V, I, F | F, Y, V, L, A, H, S, IW, C, N, G, D, T, P |
| 48 | G | E, Q, G, D, A, K, R, L, P, S, V, H, T, N, W, M, I |
| 45 | L | L, R, P, H, F, G, Q, S, E, T, Y, C, I, D, V |
| 47 | W, Y | F, L, W, G, I, S, A, V, M, R, Y, E, P, T, C, H, K, Q, N, D |
| 83 | R, K | R, K, T, E, Q, N, S, I, V, G, M, L, A, D, Y, H |
| 84 | A, T, D | P, S, H, L, A, V, I, T F, D, R, Y, N, Q, G, E |
| 103 | W | W, R, G, S, K, A, M, Y, L, F, T, N, V, Q, P, E, C |
| 104 | G | G, A, S, T, D, P, N, E, C, L |
| 108 | L, M, T | Q, L, R, P, E, K, S, T, M, A, H | wherein when positions 44, 45, 46, and 47 are G,L,E, and W, respectively, postion 108 is always Q in non-humanized V$_{HH}$ sequences that also contain a W at position 103.

8. The protein or polypeptide according to claim 2, wherein said 21F06-like sequence is SEQ ID NO: 22, optionally, with one or more of the amino acid residues at position 11, 37, 44, 47, 83, 84, 103, 104 and 108 according to the Kabat numbering chosen from the Hallmark residues mentioned in the following table:

| Position | Human VH$_3$ | Hallmark Residues |
|---|---|---|
| 11 | L, V | L, S, V, M, W, F, T, Q, E, A, R, G, K, Y, N, P, I |
| 37 | V, I, F | F, Y, V, L, A, H, S, IW, C, N, G, D, T, P |
| 48 | G | E, Q, G, D, A, K, R, L, P, S, V, H, T, N, W, M, I |
| 45 | L | L, R, P, H, F, G, Q, S, E, T, Y, C, I, D, V |
| 47 | W, Y | F, L, W, G, I, S, A, V, M, R, Y, E, P, T, C, H, K, Q, N, D |
| 83 | R, K | R, K, T, E, Q, N, S, I, V, G, M, L, A, D, Y, H |
| 84 | A, T, D | P, S, H, L, A, V, I, T F, D, R, Y, N, Q, G, E |
| 103 | W | W, R, G, S, K, A, M, Y, L, F, T, N, V, Q, P, E, C |
| 104 | G | G, A, S, T, D, P, N, E, C, L |
| 108 | L, M, T | Q, L, R, P, E, K, S, T, M, A, H | wherein when positions 44, 45, 46, and 47 are G,L,E, and W, respectively, position 108 is always Q in non-humanized V$_{HH}$ sequences that also contain a W at position 103.

* * * * *